(12) United States Patent
Lawrence et al.

(10) Patent No.: US 9,504,740 B2
(45) Date of Patent: *Nov. 29, 2016

(54) HAEMOPHILUS PARASUIS VACCINE SEROVAR TYPE FOUR

(71) Applicant: MERIAL LIMITED, Duluth, GA (US)

(72) Inventors: Paulraj Kirubakaran Lawrence, Worthington, MN (US); Russell F. Bey, Arden Hills, MN (US)

(73) Assignee: MERIAL, INC., Duluth, GA (US)

(*) Notice: Subject to any disclaimer, the term of this patent is extended or adjusted under 35 U.S.C. 154(b) by 0 days.

This patent is subject to a terminal disclaimer.

(21) Appl. No.: 14/507,397

(22) Filed: Oct. 6, 2014

(65) Prior Publication Data

US 2015/0098968 A1 Apr. 9, 2015

Related U.S. Application Data

(60) Provisional application No. 61/886,991, filed on Oct. 4, 2013.

(51) Int. Cl.
*A61K 39/102* (2006.01)
*A61K 39/00* (2006.01)

(52) U.S. Cl.
CPC ....... *A61K 39/102* (2013.01); *A61K 2039/521* (2013.01); *A61K 2039/552* (2013.01); *A61K 2039/70* (2013.01)

(58) Field of Classification Search
None
See application file for complete search history.

(56) References Cited

U.S. PATENT DOCUMENTS 8,404,253 B2 * 3/2013 Oliveira ............... A61K 39/102
424/256.1
2010/0255035 A1 * 10/2010 Oliveira ............... A61K 39/102
424/256.1

FOREIGN PATENT DOCUMENTS

CN 101721696 * 6/2010
WO WO 2011/131789 A1 10/2011

OTHER PUBLICATIONS

ParaSail vaccine brochure obtained from www on Nov. 24, 2015.*
Tadjine et al (Microbiology, 150:3935-45, 2004).*
English translation of CN 101721696.*
Database WPI Week 201381 Thomson Scientific AN 2013-T25429 XP002734902 & CN 103 194 413 A (Jiangsu Agric Sci Inst) Jul. 10, 2013 abstract.
Database WPI Week 201337 Thomson Scientific AN 2013-H24025 XP002734903 & CN 102 908 615 A (Pulike Bioengineering Co Ltd) Feb. 6, 2013 abstract.
Database WPI Week 201226 Thomson Scientific AN 2012-B99507 XP002734904 & CN 102 329 746 A (Wuhan Keqian Animal Biological Prod Co) Jan. 25, 2012 abstract.
Database WPI Week 201256 Thomson Scientific AN 2012-J40909 XP002734905 & CN 102 499 982 A (Qingdao Yebio Bioengineering Co Ltd) Jun. 20, 2012 abstract.
"Summary of Product Characteristics" Nov. 2012 XP002734906 http://mri.medagencies.org/download/UK_V_0279_001_FinalSPC.pdf.
PK Lawrence et al., "Genome Wide Association Studies of Virulent and Avirulent *Haemophilus parasuis* Serotype 4 Strains" Genome Announcements vol. 2(5) Sep. 4, 2014 pp. 1-2 XP055163227 DOI: 10.1128/genomeA.00884-14.
English translation of CN 103 194 413 A abstract.
English translation of CN 102 908 615 abstract.
English translation of CN 102 329 746 A abstract.
English translation of CN 102 499 982 A abstract.

* cited by examiner

*Primary Examiner* — Patricia Duffy
(74) *Attorney, Agent, or Firm* — Judy Jarecki-Black; Ruoying Chen; Merial Inc.

(57) ABSTRACT

The present invention is a *Haemophilus parasuis* vaccine against serovar type 4 capable of triggering a protective immune response when administered to pigs as a killed vaccine. The present invention is also a method for vaccinating swine against *Haemophilus parasuis* infection, serovar type 4, by a) clonally propagating one or more cells which are capable of triggering an immune response against *Haemophilus parasuis* infection, serovar type 4, that protects the pig against *Haemophilus parasuis* infection, and b) combining an immunologically effective amount of the cells with a veterinarily acceptable carrier in a form suitable for administration as a vaccine to the pig, and c) administering as a killed vaccine. The cell culture is from a pathogenic parent strain.

8 Claims, 1 Drawing Sheet

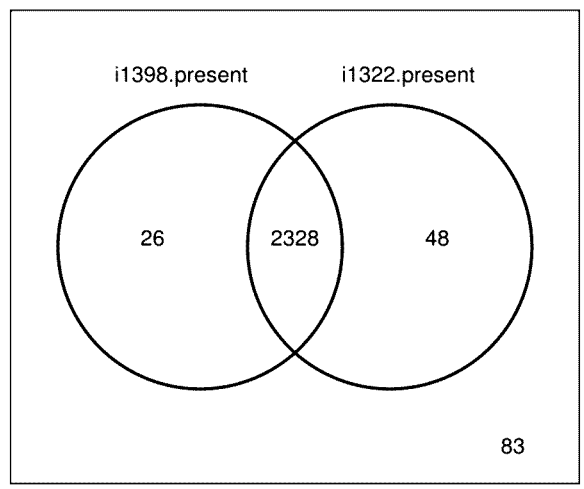

HAEMOPHILUS PARASUIS VACCINE SEROVAR TYPE FOUR

STATEMENT REGARDING SEQUENCE LISTING

The Sequence Listing associated with this application is provided in text format in lieu of a paper copy, and is hereby incorporated by reference into the specification. The name of the text file containing the Sequence Listing is H parasuis genomic—Paul Lawrence_ST25. The text file is 8,732 KB; it was created on 2 Oct. 2013; and it is being submitted electronically via EFS-Web, concurrent with the filing of the specification.

BACKGROUND OF THE INVENTION

*Haemophilus parasuis* is a γ-proteobacteria and is classified in the Pasteurellaceae family. *H. parasuis* is a rod-shaped, non-haemolytic, gram-negative nicotinamide adenine dinucleotide (NAD)-dependent bacterium (Biberstenia and White, 1969; Nicolet 1992). *H. parasuis* is a commensal of the upper respiratory tract of healthy pigs. It is also an important pathogen and the etiological agent of Glasser's disease, which is typically characterized by fibrinous polyserositis, polyarthritis, meningitis and sometimes acute pneumonia and septicemia (Amano et al., 1994; Peet et al., 1983; Little, 1970). This disease is one of the main causes of swine mortality in the US and swine industries worldwide, resulting in huge economic losses.

Recent studies have demonstrated that non-virulent strains are more prevalent in the upper respiratory tract than virulent strains however, they are not protected against systemic infection by virulent strains.

Based on heat-stable antigens and gel diffusion test data, fifteen serovars of *H. parasuis* have been identified so far, but a high percentage of the field isolates are non-typable (Kielstein and Rapp-Gabrielson, 1992). Different serovars of *H. parsuis* exhibit different virulence, ranging from highly virulent to nonvirulent. Of the 15 recognized serovars, serovar 5 strains are isolated more frequently worldwide than any other. The serovar 5 strain is also frequently isolated from respiratory and systemic infection in pigs and is highly virulent (Rapp-Gabrielson and Gabrielson, 1992; Blackall et al., 1996; Oliveira, 2003). Furthermore, it has emerged recently as one of the major causes of neonatal mortality in the pig industry worldwide as well.

Newport Laboratories developed a commercial vaccine (ParaSail) against *H. parasuis* infection using a highly virulent serovar 5 North American field isolate. This vaccine—when used as recommended by swine producers—is highly effective in mitigating *H. parasuis* infection in the United States. Recently, however, a few farms in the Midwestern United States using this vaccine had reported outbreaks of severe pneumonia. Tissue samples obtained by Newport Laboratories during the 2011-2012 outbreak yielded a highly virulent isolate of *H. parasuis* serotype 4 strains. The reason for outbreak was unknown at the time, although internal challenge studies showed that ParaSail vaccine when used at $10^9$ CFU per dose protects pigs against *H. parasuis* serotype 4 strains.

Like the rest of the members of Pasteurellaceae, *H. parasuis* has a large number of virulence and virulence-associated genes. These include lipopolysaccharide (LPS), capsular polysaccharide, adhesins/fimbriae, outer membrane proteins, neuraminidase, iron and heavy metal acquisition and transport systems (Amano et al., 1994; Biberstein, 1990; Munch et al., 1992; Zucker et al., 1996; Morozumi and Nicolet, 1986). The molecular basis underlying these candidate virulence factors is yet to be fully elucidated, however, due to the complex gene regulatory mechanisms involved. *H. parasuis* strains exhibit high heterogeneity at the molecular level, mostly due to recombination or lateral gene transfer. In order to elucidate the possible reasons behind the 2011-2012 Midwest outbreaks at the molecular level we sequenced the genomes of two *H. parasuis* serotype 4 isolates and performed a 3-way comparative genomic analysis against our Parasail vaccine strain (used as a reference; SEQ ID NO. 1). The two *H. parasuis* serotype 4 isolates were obtained from Newport Laboratories case numbers 12-1322 (SEQ ID NO. 2; GenBank accession number JJNQ00000000; ST4-1) and 11-1398-2 (SEQ ID NO. 3; GenBank accession number JJNR00000000; ST4-2).

Although neither the mechanisms involved in the protective immunity following controlled exposure nor the identity of antigens which provide protective immunity are clear at this time, it is known that protective immunity can be induced by such exposure.

The pork industry is in immediate need of a safe and efficacious product capable of aiding the prevention of disease, specifically *Haemophilus parasuis* serotype 4.

SUMMARY OF THE INVENTION

In one aspect, the invention is a vaccine for *Haemophilus parasuis*, serovar type 4, comprising a veterinarily acceptable carrier and an immunologically effective amount of killed bacterin or bacterial cell culture capable of triggering an immune response that protects the pig against *Haemophilus parasuis* infection. In another aspect, the invention is a vaccine wherein the DNA sequence of the bacterin or bacterial cell culture includes SEQ ID NO: 2. In another aspect, the invention is a vaccine wherein the DNA sequence of the bacterin or bacterial cell culture includes SEQ ID NO. 3. In another aspect, the vaccine of the invention includes the ParaSail vaccine against *Haemophilus parasuis*, serovar type 5.

In another embodiment, the invention is a method for vaccinating swine against *Haemophilus parasuis* infection, serovar type 4, comprising the steps of a) clonally propagating one or more cells which are capable of triggering an immune response against *Haemophilus parasuis* infection, serovar type 4, that protects the pig against *Haemophilus parasuis* infection, and b) combining an immunologically effective amount of the cells with a veterinarily acceptable carrier in a form suitable for administration as a vaccine to the pig, and c) administering as a killed vaccine. In one aspect, the method for vaccinating swine with a killed vaccine includes the DNA sequence of SEQ ID NO. 2. In another aspect, the method for vaccinating swine with a killed vaccine includes the DNA sequence of SEQ ID NO. 3. In yet another aspect, the method for vaccinating swine includes administration of the Parasail vaccine against *Haemophilus parasuis*, serovar type 5.

BRIEF DESCRIPTION OF FIGURES

FIG. 1: Venn diagram representing the number of genes unique to *H. parasuis* ST4 isolates 12-1322 (i.e., ST4-1; SEQ ID NO. 2) and 11-1398-2 (i.e., ST4-2; SEQ ID NO. 3) compared with the ParaSail vaccine (SEQ ID NO. 1).

DETAILED DESCRIPTION OF THE INVENTION

Applicants have discovered that the commercially available Parasail vaccine against *Haemophilus parasuis* (serovar type 5) may not sufficiently vaccinate swine against a mutant strain of *Haemophilus parasuis* serovar type 4 (i.e., ST4). A killed vaccine is herein presented capable of triggering an immune response that protects pigs against *Haemophilus parasuis* ST4 infection.

The present invention further provides a method for preparing a vaccine to protect pigs against *Haemophilus parasuis* infection, serovar type 4, comprising selecting and clonally propagating one or more cells which are capable of triggering an immune response against *Haemophilus parasuis* infection, serovar type 4, that protects the pig against *Haemophilus parasuis* infection when administered as a killed vaccine, and combining an immunologically effective amount of the cells with a veterinarily acceptable carrier in a form suitable for administration as a live vaccine to the pig.

Example 1

The objective of this study was to determine if pigs vaccinated with ParaSail alone or in combination with an autogenous bacterin were protected against disease associated with *Haemophilus parasuis* (*H. parasuis*) type 4 (11-1398-2; SEQ ID NO. 3). This study included three groups; Group A (n=15) received 1 mL ParaSail per label directions and 1 mL of an autogenous type 4 bacterin, Group B (n=15) received 1 mL ParaSail per label directions, followed by 1 mL of an autogenous type 4 bacterin two weeks later and Group C (n=14) received 1 mL of ParaSail (adjuvanted with Quil and Trigen) per label directions. The last group (D) (n=13) served as non-vaccinated controls. All enrolled pigs were challenged with an *H. parasuis* type 4 (11-1398-2; SEQ ID NO. 3) field strain 40 days following initial vaccination. Challenged animals were observed daily for clinical signs of disease and death. Five days following challenge, all surviving animals were sacrificed and necropsied. Animals with lesions typical of *H. parasuis* were recorded.

ParaSail, when paired with the autogenous type 4, protected better than when ParaSail was given alone. Furthermore, Parasail and *H. parasuis* type 4 bacterin administered on the same day afforded a better protection compared to 2 weeks later.

Objective

The objective of this study was to determine if ParaSail, administered per label directions and/or paired with an autogenous bacterin, protected against disease associated with an *H. parasuis* type 4 field isolate (11-1398-2; SEQ ID NO. 3).

Materials and Methods

The Parasail vaccine used was a released ParaSail serial (15B030710). The serial passed all USDA-required testing in Newport Laboratories' Quality Control facility. The potency for this serial was 8.17 logs per dose.

Autogenous vaccine: A homologous killed vaccine was prepared by growing a live culture of isolate 11-1398-2 (SEQ ID NO. 3) and inactivating the culture according to the Newport Laboratories' Standard Operating Procedure for *Haemophilus parasuis* antigen production. The potency was approximately 8.4 logs per dose.

Animals: Sixty seven pigs were received from Midwest Research Swine (Princeton site) at 17-21 days of age. All pigs were healthy and normal at time of vaccination.

Pre-challenge: A group of 10 pigs were held in a separate room and challenged 1 week prior to the study challenge. This group aided in determining an appropriate challenge titer. Five pigs received 1 mL IP and 1 mL IV of a 2.45 log culture and 5 pigs received 1 mL IP and 1 mL IV of a 3.4 log culture. Animals were observed for 5 days for clinical signs of disease and death. The results are summarized in Table 1.

TABLE 1

| Titer | Clinical Signs | Death |
|---|---|---|
| 2.45 logs | 5/5 (100%) | 4/5 (80%) |
| 3.4 logs | 5/5 (100%) | 5/5 (100%) |

Based on the results of the pre-challenge, a challenge titer of approximately 2.45 logs was selected.

Challenge: The challenge strain was a field isolate received via Prestage Farms. The strain was isolated from porcine lung tissue at MVP Laboratories and determined to be *H. parasuis* type 4. All pigs received 1 mL IV and 1 mL IP of a 2.78 log culture on the day of challenge. Table 2 summarized the schedule of events.

TABLE 2

| Day | Action |
|---|---|
| 0 | Vaccinate, bleed |
| 12 | Booster Group B pigs only, bleed |
| 26 | Pre-challenge |
| 40 | Challenge, bleed all |
| 41-44 | Observations of clinical signs |
| 44 | Necropsy, score lesions |

Treatment Groups:

A. ParaSail+Autogenous Type 4: administered simultaneously, 1 mL on either side of neck (n=15).

B. ParaSail+Autogenous Type 4: ParaSail given on day 0, autogenous given on day 12 (n=15).

C. ParaSail only: adjuvanted with Quil and Trigen (1 dose) (n=14).

D. Controls (n=13).

Observations:

Pigs were observed daily following challenge for clinical signs of disease associated with *H. parasuis* including lameness, labored breathing, vomiting, and sudden death. All observations were conducted and recorded by study personnel blinded to treatment group allocation. Any pig unable to rise was euthanized for humane reasons.

Necropsies:

Any pig that was found dead or was euthanized during the study observation period was assumed to have internal lesions including peritonitis, pleuritis, and/or pericarditis. At 5 days post-challenge all surviving pigs were euthanized and necropsied. The presence of gross lesions including peritonitis, pleuritis, pericarditis, and swollen joints were recorded.

Analysis:

Statistical analysis was performed by Tammy Kolander using SAS software.

A t-test and a Tukey HSD all-pairwise compared clinical signs, death, and the presence of lesions between the vaccinate groups and the controls. Table 3 summarizes the raw data collected for clinical signs, death, and gross lesions.

TABLE 3

| Group | Treatment | % with clinical signs (including death) | % died during the study | % with lesions at necropsy or died during study | % with lesions at necropsy (surviving pigs only) |
|---|---|---|---|---|---|
| A | ParaSail + Autogenous (simultaneous) | 0% (0/15) | 0% (0/15) | 7% (1/15) | (1/15) 7% |
| B | ParaSail + Autogenous (2 weeks between) | 20% (3/15) | 7% (1/15) | 20% (3/15) | (2/13) 15% |
| C | ParaSail (Quil + Trigen) | 21% (3/14) | 14% (2/14) | 29% (4/14) | (2/12) 17% |
| D | Control | 54% (7/13) | 38% (5/13) | 69% (9/13) | (4/8) 50% |

Statistical analysis concluded the following regarding significant differences between the vaccinated pigs and controls:

Clinical signs (including death): The t-test found the Controls to be significantly different from all the other treatments, but none of the other treatments (A-D) were significantly different from one another. Tukey's all pairwise comparison found only the Controls and Group A to be significantly different from one another, and no difference between any other combinations.

Death during observations: The t-test showed a significant difference between the Controls (group D) and Group B and between the Controls (group D) and Group A. There were no significant differences between any of the other groups. Tukey's all pairwise comparison resulted in a significant difference between Group A and the Controls; there were no differences between any other groups.

Lesions at necropsy (and death during observations): The t-test showed significant differences in the Controls verses Groups A-C, with no significant differences between groups A-C. Tukey's all pairwise comparison resulted in a significant difference between the Controls and Group A and the Controls and Group B.

Three parameters of the presence of disease caused by H. parasuis were investigated: clinical signs during observations, death during observations, and the presence of lesions at necropsy. Two different statistical tests were conducted comparing each parameter between each group. The results clearly indicate the advantage of administering H. parasuis type 4 bacterin along with Parasil formulation. Adding H. parasuis type 4 bacterin significantly reduces lung lesions, clinical signs and decreases losses due to death.

Genomic DNA Sequencing

The genomic DNA from two H. parasuis ST4 field strains (12-1322; SEQ ID NO. 2 and 11-1398-2; SEQ ID NO. 3) and ParaSail vaccine (serotype 5, ST5; SEQ ID NO. 1) was isolated using bacterial genomic DNA isolation kit (Edge Biosystems) and sequenced by Illumina HiSeq paired end 50 (PESO).

Sequence Analysis

The H. parasuis ParaSail vaccine and Genbank ST5 isolate SH0165 (accession number CP001321.1) were used as reference genomes. The genome sequence of GenBank isolate was downloaded, and ABACAS (http://abacas.sourceforge.net/) was used to align SH0165 contigs and identify putative gap sizes, orientation, and order of the contigs. A custom Python script was then used to concatenate contigs, fill the gaps with N's, and transferring the annotations. Additional annotations were added to the resulting sequence to indicate gaps, and to label the original contigs. The contigs which could not be aligned against the reference were included at the end of the concatenated sequence.

Reads were filtered for quality using a custom Python script. Low quality reads were discarded (any read containing 5 or more bases with PHRED Quality <20 was considered low quality). Because of very high coverage, duplicate reads were expected and reads were only kept if at least 2 duplicates existed. A maximum of 10 duplicates were kept for each read. Following quality filtering, reads were mapped against SH0165, a concatenated set of contigs aligned and oriented using SH0165 as a reference. Reads were mapped using Bowtie2 v 2.0.6. Reads for each isolate were mapped against H. parasuis ParaSail vaccine (HSP_ref) using bowtie2 with default parameters. Filtering was then carried out to remove multiply mapped reads and MAPQ <10 using a custom script.

The Sequence Alignment/Map (SAM) output from Bowtie2 was then further analyzed using the SAMtools package in order to call variants. The resulting variant calls were then further analyzed using a custom script written in R in which variants were annotated based on their position within the genome. Variants were also filtered based on depth of coverage, and the genotype quality reported by SAMtools. SAMtools was also used to generate a consensus sequences based on the mapping results. This sequence was annotated using the reference sequence and formatted as a Genbank file for Artemis compatibility using custom scripts and BioPython.

Reads which could not be mapped to the reference by Bowtie2 (consisting of ~10% of reads) were identified and assembled using the Roche GsAssembler (Newbler) v2.6. Assemblies had a total length of 150 and 190 Kb, and consisted of 149 and 194 contigs for 51322 and 51398 respectively. The gene prediction program Prodigal v2.6 was used to predict genes in the assembled contigs, these genes were then given putative annotation using the software tool BLANNOTATOR.

Single Nucleotide Polymorphisms (SNPs) and Consensus Calls

SNPs were identified using the "SAMTools mpileup" pipeline and then filtered and annotated using a custom R script. The SNPs were identified across the 3 strains.

Gene Coverage

Mapping coverage was calculated for each position in reference using samtools. Gene annotation information was then used to calculate the percentage of bases which had coverage for each gene. Genes in which less than 80% of bases had coverage were called absent.

Gene Coverage and Overall Mapping

About 2328 genes were common to all three isolates. There were 83 genes unique to the parasail vaccine (SEQ ID NO. 1), 48 genes unique to 12-1322 (SEQ ID NO. 2) and 26 genes unique to 11-1398-2 (SEQ ID NO. 3) See FIG. 1.

The reads were filtered for quality and Illumina TruSeq adapters using an in-house script which removed reads in which 5 or more bases had a Q-value <20. We obtained 255× coverage for isolate 11-1398-2 and 300× coverage for 12-1322 respectively. Both the *H. parasuis* ST4 isolates mapped ~90% to the reference Parasail vaccine.

The *H. parasuis* ST4 strains lack enzymes such as UDP-glucose-4-epimerase, toxin-antitoxin system and a large number of hypothetical proteins.

Notable enzymes altering the outer membrane protein (OMP) and lipooliosaccharide (LOS) structure are sialyltransferase, glycosyl transferases, polysaccharide biosynthesis protein capD, spore coat polysaccharide biosynthesis protein C and polysaccharide export protein. These proteins are involved in serotype determination, immune evasion and act as virulence factors. In addition, *H. parasuis* ST4-1 (i.e., SEQ ID NO. 2) and ST4-2 (i.e., SEQ ID NO. 3) encode other virulence and virulence associated genes found in the Newport Laboratories *H. parasuis* ST5 wild type as well. The functional significance of each of these proteins and genes in comparison to *H. parasuis* ST5 and other pathogenic bacteria are discussed below.

Sialyltransferase

Sialylation of LOS has been implicated as a bacterial virulence factor by inhibiting antibody binding and enhancing bacterial serum resistance. The genes encoding the α-2, 3-sialyltransferases are involved in LOS biosynthesis in the members of pathogenic bacteria belonging to the Pasteurellaceae family, such as *Neisseria gonorrhoeae, Haemophilus ducreyi, Haemophilus influenzae* and *Histophilus somni* (Vimr and Lichtensteiger 2002; Inzana et al., 2002). Sialylated LOS aids host immune evasion by its molecular mimicry. Furthermore, pathogenic bacteria also utilize linkage-specific sialyltransferases, such as an α-2, 3 linkage to galactose, or an α-2, 6 linkage to galactose or N-acetylgalactosamine to sialylate its LOS in order to avoid host innate defense mechanisms (Inzana et al., 2002). It has been speculated that sialylated LOS induce significantly less cytokine response from macrophages by inhibiting the TLR-4 signaling pathway, which in turn induces significantly less transcription factor NF-κB than de-sialylated LOS (Vimr et al., 2000; Severi et al., 2007).

Earlier reports indicate the presence of sialyltransferase-encoding gene (lsgB) only in virulent *H. parasuis* strains, which also display a higher resistance to serum-mediated killing and phagocytosis by alveolar macrophages than strains lacking lsgB (ref). However, pigs infected with variant *H. parasuis* ST4 showed signs of acute pneumonia and septicemia indicating a "cytokine storm" as a result of infection. Furthermore, pure *H. parasuis* ST4 cultures were obtained from tissue samples. When mice were injected with a de-sialylated *P. multocida* mutant all the mice died within 48 hours due to septicemia, indicating an exuberant immune response. On the other hand, mice injected with sialylated (wild type) *P. multocida* did not die, but had injection-site swelling only (Newport Laboratories internal report).

*H. parasuis* ST4 and ST5 lack de novo sialic acid biosynthesis, but the genome encodes two tripartite ATP-independent periplasmic transporters, Neu5Ac TARP (HPM_1229, HPM_0026), a TRAP permease (HPM_0027) and CMP-Neu5 Ac synthetase gene (HPM_0608) and acylneuraminate cytidylyltransferase (HPM_1673), which indicates a sialic acid scavenge mechanism similar to *H. influenza* and synthesis of CMP-Neu5Ac.

Since the variant *H. parasuis* ST4 lack α-2, 3-sialyltransferases, we hypothesized that the amount of sialic acid coupled to LOS should be less than that of ST5. The amount of sialic acid coupled to LOS was determined after treating the cells with neuraminidase. The variant *H. parasuis* ST4 strains had significantly less sialic acid residues linked to LOS when compared to ST5 wild type (data not shown). These results contradict the current dogma that sialic acid is necessary for *H. parasuis* virulence. When variant ST4-1 (i.e., SEQ ID NO. 2) was used in challenge studies (15, 3 week old piglets) 54% showed clinical signs and died when compared to control which had 0% mortality, clearly indicating that LOS sialylation is not necessary for virulence. The variant *H. parasuis* ST4 strains possess other virulence factors that help subvert the host immune response and aid in pathogenesis. These virulence and virulence associated factors are discussed below.

Glycosyl Transferases

The variant *H. parasuis* ST4 strains lack four glycosyl transferases (HPM_1373, HPM_1372 and HPM_1370 and HPM_1371). Glycosyl transferases catalyze the reaction involving the addition of carbohydrate side group to a protein or lipid molecule. Addition of carbohydrate residues to proteins significantly alters its biophysical and structural properties like solubility index, resistance to proteases, stability, interaction with other proteins and most importantly the immunogenicity of pathogenic bacteria (Lairson et al., 2008). The two important and common types of protein glycosylation are N-linked and O-linked. N-linked glycosylation is a co-translational process involving the transfer of a precursor oligosaccharide to asparagine residues in a sequon Asn-X-Ser/Thr (N-X-S/T), where X is any amino acid other than Proline (Yan and Lennarz, 2005). In contrast, O-linked glycosylation involves the post-translational transfer of an oligosaccharide to a serine or threonine residue (Van den Steen et al., 1998). Many of the surface and secreted proteins are modified by glycosylation, which in turn affects how bacteria interact with their environment and host immune system (Szymanski and Wren, 2005; Schmidt et al., 2003). The lack of glycosyl transferases in variant *H. parasuis* ST4 strains suggests alternate pathways of glycosylation since different groups of glycosyl transferases have overlapping functions. However, many enzymes involved in cell wall biosynthesis like N-acetylmuramyl-tripeptide synthetase protein (HPM_1513), MurNAc-pentapeptide synthetase (HPM_1514), phospho-N-acetylmuramoyl-pentapeptide-transferase (HPM_1515), UDP-N-acetylmuramoyl-L-alanyl-D-glutamate synthetase (HPM_1945), D-alanine-D-alanine ligase (HPM_2304), UDP-3-O-acyl-N-acetylglucosamine deacetylase (HPM_2413) and exopolysaccharide biosynthesis protein (HPM_0770) present are identical across all three isolates (data not shown). Modified LOS and OMP glycosylation pattern of variant *H. parasuis* ST4 strains probably help avoid phagocytosis.

Polysaccharide Export Protein and Polysaccharide Biosynthesis Protein CapD

Polysaccharide export protein and polysaccharide biosynthesis protein are located as contiguous ORFs in *H. parasuis* ST4 and ST5 strains. Bacteria export extracellular polysaccharides (EPS) and capsular polysaccharides (CPS) through a complex transport system (Cuthbertson et al, 2009). These biopolymers serve various biological functions, such as providing reserve material or as part of a protective structure and can provide a substantial advantage for pathogenic bacteria under certain environmental conditions. In pathogenic bacteria, production and export of EPS and CPS poses a major challenge because these high-molecular-weight hydrophilic polymers must be assembled and exported across the envelope, without compromising the essential functional properties of the envelope (Cuthbertson et al, 2009). Two major pathways with different polymer biosynthesis strategies are employed by bacteria in the assembly of most EPS/CPS: the Wzy-dependent and ATP-binding cassette (ABC) transporter-dependent pathways (Lame et al., 2011). They converge in an outer membrane export step mediated by a member of the outer membrane auxiliary (OMA) protein family. OMA proteins form outer membrane efflux channels for the biopolymers (ref). The polysaccharide copolymerase (PCP) family of enzymes interact with OMA proteins to form a trans-envelope scaffold for polymer export (Lame et al., 2011). The variant *H. parasuis* ST4 strains have numerous ABC transporter systems similar to virulent *H. parasuis* ST5 but lack polysaccharide export protein (HPM_0299) wza. This demonstrates a functional overlap between ABC transporters in exporting complex carbohydrates and biopolymers.

The capD gene (HPM_0300) encodes a polysaccharide biosynthesis protein. This protein has been implicated in *H. parasuis* virulence, however, the characteristics of this gene associating with the pathogenicity of *H. parasuis* has not been delineated. This domain is found in diverse bacterial polysaccharide biosynthesis proteins including the WalL protein, mannosyl-transferase and epimerases (Whitfield, 2006). The CapD protein is required for biosynthesis of type 1 capsular polysaccharide in *Staphylococcus* spp. (Lin et al., 1994). In *H. parsuis* capD protein is implicated in serum-resistance. However, variant *H. parasuis* ST4-1 (i.e., SEQ ID NO. 2) and ST4-2 (i.e., SEQ ID NO. 3) strains lack this domain but are highly virulent and were recovered as pure culture from dead pigs, proving serum-resistance without capD protein. Earlier reports indicate that the deletion of capD gene significantly attenuates SH0165 pathogenicity, while the complementation of this gene largely restored the pathogenicity in piglets (Wang et al., 2013). Furthermore, the capD deleted SH0165 strains were not recovered from piglets after challenge, while both SH0165 wild type and complemented-capD strains were recovered from most systemic sites (Wang et al., 2013). In contrast to SH1065 virulent strain, the variant *H. parasuis* ST4 isolates caused a rapid onset of clinical signs and two out of the four pigs died during our study. When the pigs were necropsied we found lesions typical to *H. parasuis* infection and isolated virulent *H. parasuis* ST4, the original challenge strain.

PCR Analysis of Virulence Genes

The variant *H. parasuis* ST4-1 (i.e., SEQ ID NO. 2) and ST4-2 (i.e., SEQ ID NO. 3) strains lack ORFs HPM_1370, HPM_1371, HPM_1372, HPM_1373, HPM_0299 and HPM_0300, reiterating our in silico based analysis. On the other hand *H. parasuis* variant ST4 strains possess all three virulence associated trimeric autotransporters (vtaA) domains similar to virulent *H. parasuis* ST5. Comparative genomic analysis have indicated that group 3 vtaA is highly conserved among both invasive and non-invasive strains, while groups 1 and 2 vtaA were detected only in virulent strains (Pina et al., 2009). However, we detected all three domains in highly virulent, ST4-1 (i.e., SEQ ID NO. 2), ST4-2 (i.e., SEQ ID NO. 3), and ST5 well as in an avirulent ST5 strain (Newport Laboratories internal report). We speculate that characterization of non-virulent and virulent *H. parasuis* strains based on vtaA domains may not be a reliable approach given the complex gene regulation mechanism involved in determining *H. parasuis* virulence.

Other Virulence and Virulence Associated Genes

Other than the known virulence genes, *H. parasuis* ST4 and ST5 genomes encode a large number of other virulence and virulence associated genes. These include regulation of uptake of metal ions, MerR family transcriptional regulators, macrophage infectivity potentiator-related protein, hemolysin, opacity associated protein, toxin antitoxin system, virulence associated protein D, colicins and cytolethal distending toxin.

Regulation of Uptake of Metal Ions

Like many pathogenic bacteria, variant *H. parasuis* ST4-1 (i.e., SEQ ID NO. 2), ST4-2 (i.e., SEQ ID NO. 3) strains and ST5 have extensive regulatory and protein-coding machinery exclusively devoted to maintain the homeostasis of biologically required metal ions. Most of these metal ions must be acquired from the environment. Among the metal ions, iron is the chief regulator of many virulence genes and variant *H. parasuis* ST4-1 (i.e., SEQ ID NO. 2), ST4-2 (i.e., SEQ ID NO. 3) and ST5 has an extensive protein network to regulate iron. Iron is generally a growth limiting factor for pathogenic bacteria due to the low solubility of Fe(III) in water at neutral pH, but is required for a number of essential metabolic enzymes, including the cytochromes, ribonucleotide reductase, Fe—S cluster biogenesis and activation/regulation of virulence genes (Laham and Ehrlich 2004). Most of the mammalian hosts lack free iron for uptake, since most of it is stored in intracellular or extracellular tightly bound forms like transferrin, lactoferrin, haemopexin and haptoglobin (Litwin and Calderwood 1993). Many outer membrane (OM) receptor proteins like ferroxamine (HPM_2297) first bind to lactoferrin or ferritin and mediate the transport. These receptors are usually 22-stranded β-barrel proteins that contain extracellular loops that bind substrates, and an N-terminal region or plug, that folds into the barrel near the periplasmic surface (Ferguson et al., 2002). Since there are no ionic gradient to drive this transport, transport across the OM is coupled to the proton motive force of the cytoplasmic membrane via a periplasm-spanning complex composed of TonB (HPM_0089 and HPM_0090), ExbB (HPM_0091), and ExbD (HPM_0092) (Braun et al., 1996). Once in the periplasm, the uptake of Fe (III) or Fe (III)-chelates occurs through the transmembrane channel of ATP-binding cassette (ABC) transporters (Davidson et al., 2008) found in the plasma membrane. This process is mediated by ATP hydrolysis. *H. parasuis* ST4 and ST5 also possess three heme binding proteins (HPM_0689, HPM_2386 and HPM_0785) which bind to heme and hemin and are involved in heme acquisition. Variant *H. parasuis* ST4 also encodes iron-binding protein IscA (HPM_1829), which transfers intracellular free iron to, for example, apo-ferredoxin, iron utilization protein hugX (HPM_0784), ferric iron reductase (HPM_1543, involved in ferric hydroximate transport), very high affinity iron scavenging proteins hemopexin B and A (HPM_1235 and HPM_1236), two periplasmic iron uptake and binding proteins (HPM_1161 and HPM_1150), ferric transporter ATP-binding subunit (HPM_1466), and high affinity heme/hemopexin utilization protein C/outer membrane receptor protein (HPM_1031; transports Fe ions) and ferric uptake regulation protein (HPM_1051). The heme exporter protein B (HPM_2191), which exports heme to the periplasm for the biogenesis of c-type cytochromes, is adjacent to cytochrome c biogenesis ATP-binding export protein CcmA (HPM_2192). *H. parasuis* ST4 and ST5 encode two outer membrane TonB dependent receptors or iron regulated outer membrane proteins, IROMP (HPM_0168 and HPM_0415). *H. parasuis* ST5 and ST4 also encode three small multifunctional proteins, frataxin (HPM_1028), ferredoxins (HPM_0902) and Ferritin/DNA-binding stress protein (HPM_2074). Frataxin acts as an iron chaperone during cellular heme and iron-sulfur (Fe—S) cluster production, scavenges iron and stores iron during iron overload, repairs oxidatively damaged aconitase Fe—S clusters, reduces oxidative stress by moderating the concentration of reactive oxygen species (ROS) and is involved in energy conversion and oxidative phosphorylation. Ferredoxins are proteins containing iron and sulfur atoms organized as iron-sulfur clusters (4Fe-4S), which are involved in electron transfer during biological redox reactions (Carvajal et al., 1996). The function of ferredoxins overlaps with the formate dehydrogenase iron-sulfur subunit. It contains hydrogenase component 1 (HPM_1699) which is involved in the use of formate as a major electron donor during aerobic respiration. Ferritin is another cytoplasmic protein that binds and sequesters iron and releases in a controlled fashion. In addition, ferritin binds to DNA and delivers iron into the nucleus for iron-dependent enzyme or transcription factors (Prince and Grossman, 1993; Demple et al., 1999; Khoroshilova et al., 1997). Thus, *H. parasuis* ST4-1 (i.e., SEQ ID NO. 2), ST4-2 (i.e., SEQ ID NO. 3) and ST5 genomes encode a large number of proteins with overlapping functions involved in maintaining iron homeostasis, indicating the critical role of iron in *H. parasuis* pathogenesis. These proteins can also be targeted to develop universal vaccines or for strain identification.

In addition to iron, *H. parasuis* also requires metal ions like molybdenum, zinc, copper, nickel, magnesium for the activation of many metalloproteases, metabolic enzymes and DNAse. *H. parasuis* ST4-1 (i.e., SEQ ID NO. 2), ST4-2 (i.e., SEQ ID NO. 3) and ST5 has an extensive network of proteins to acquire these metals which include molybdenum cofactor biosynthesis (HPM_0200), molybdoprotein biosynthesis protein, molybdoprotein biosynthesis MoeB and two MoeA (HPM_0201, HPM_1239 and HPM_1012, respectively), moylbdate ATP transporter (HPM_1718), molybdate ABC transporter (HPM_1719), molybdenum transport protein (HPM_0692), molybdate-binding periplasmic protein (HPM_0693), molybdenum cofactor biosynthesis protein C' (HPM_0289), molybdopterin converting factor (HPM_0290), zinc ABC transporter (HPM_0361, HPM_1198), high-affinity zinc transporter periplasmic component (HPM_0485), zinc/copper dismutase (HPM_0873), copper homeostasis (HPM_1035), nickel transport permease (HPM_2246), nickel-binding periplasmic precursor protein, nikA (HPM_0691), ABC-type nickel/cobalt efflux system, permease component (HPM_2454), $Mg^{2+}/Co^{2+}$ transporter (HPM_2352), magnesium dismutase (HPM_1717), and magnesium transport corA protein (HPM_0841).

MerR Family Transcriptional Regulators

The regulation of metal ion homeostasis is exclusively controlled by MerR family of transcriptional regulators. MerR family of regulators has been found in a wide range of bacteria, but none have been identified in archaea or eukaryotes. MerR transcriptional regulators function mainly as transcriptional activators of the expression of genes required for metal efflux or detoxification, defense against oxidative, biotic or abiotic stress and provide drug resistance (Lund et al., 1986). *H. parasuis* ST4 and ST5 MerR regulator (HPM_1347) is a 15.7 KDa protein and belongs to the helix-turn-helix (HTH) MerR-SF superfamily. *H. parasuis* MerR is similar to other bacterial MerR regulatory proteins and follows a canonical N-terminal HTH-DNA binding domain of about 40 amino acids. It further contains a C-terminal metal-coordinating domain of between 80-130 amino acids that is specific to the effector (metal ion) recognized (O'Halloran et al., 1989; Ma et al., 2009). The MerR families of metal-binding, metal-responsive proteins are unique in that they activate transcription from unusual promoters with a high spacing of 19 base pairs between the −35 and −10 sequences (O'Halloran et al., 1989). These cytoplasmic transcription factors coordinate (bind) metals through cysteine or histidine residues (Ma et al., 2009). Although different bacteria have a common design (i.e., conserved primary structure), they can effectively discriminate metals in vivo (Brown et al., 2003). Based on NCBI analysis (E-value: 7.89e-39) *H. parasuis* Mer R regulator appears to be heavy metal (copper, cadmium, lead, zinc) resistance transcription regulator.

Taken together, the presence of extensive metal acquisition genes along with a specific transcription regulator shows a very complex gene regulation mechanism involved in the expression of *H. parasuis* virulence genes.

Macrophage Infectivity Potentiator-Related Protein

Macrophage infectivity potentiator (MIP)-related protein has been identified in many pathogenic bacteria, such as *Neisseria*, *Actinobacillus*, *Legionella* and *Chlamydia*. It has also been identified in intracellular pathogens *Coxiella burnetii*, *Burkholderia pseudomallei* and a protozoan parasite, *Trypanosoma cruzi* (Lundemose et al., 1993; Masuzawa et al., 1997; Norville et al., 2011; Pereira et al., 2002). Variant *H. parasuis* ST4 and ST5 genomes encode a putative macrophage infectivity potentiator-related protein (HPM_0216), which is a 20 Kda outer membrane protein. Analysis shows that *H. parasuis* ST4 and ST5 MIP belongs to carboxymuconolactone decarboxylase superfamily (CMD superfamily; COG2128) indicating a multidomain architecture. *H. parasuis* ST5 and ST4 MIP contains an overlapping alkylhydroperoxidase AhpD family core domain, alkylhydroperoxidase domain protein (Avi_7169 family) and a gamma-carboxymuconolactone decarboxylase. Like the rest of the prokaryotic MIP-like proteins, the predicted N-terminal structure of *H. parasuis* ST4 and ST5 MIP contains three large alpha-helices followed by a short beta-sheet or turn.

*B. pseudomallei* MIP-like protein is sensitive to immunosuppressants like FK506 and rapamycin, which abolish its peptidylprolyl isomerase activity. *B. pseudomallei* mutants lacking MIP exhibit reduced ability to survive within cells and are significantly attenuated in vivo (Norville et al., 2011). In addition, MIP has been implicated to play a role in chlamydial entry into McCoy cells (Lundemorse et al., 1993). A similar function for *H. parasuis* MIP cannot be ruled out and may aid in intracellular invasion and survival of the bacteria. MIP-like proteins could potentially serve as a target for a universal vaccine.

Hemolysin

Hemolysins are toxic to erythrocytes, but some bacterial species produce hemolysins which lyse leukocytes as well (Cavalieri et al., 1984; Forestier and Welch 1991; Gadebeerg et al., 1983; Keane et al., 1987; Wiles et al., 2008). The variant *H. parasuis* ST4-1 (i.e., SEQ ID NO. 2), ST4-2 (i.e., SEQ ID NO. 3) and ST5 have two hemolysin activation/secretion proteins (HPM_2302 and HPM_1788) and two hemolysin structural proteins (HPM_1789 and HPM_2290). The ORFs HPM_1788 and HPM_1789 are adjacent to each other, similar to *H. ducreyi* (hhdB and hhdA), *Serratia marcescens* (shlB and shlA), *Proteus mirabilis* (hpmA and hpmB) and *Edwardsiella tarda*. However, ORFs HPM_2302 and HPM_2290 are nonadjacent. In addition, *H. parasuis* ST4 and ST5 genomes also encode AphA-like protein/membrane protein affecting hemolysin expression (HPM_2138), a 21 kDa hemolysin precursor protein (HPM_0599) and another possible hemolysin structural protein (HPM_0082). Earlier studies have shown that the *S. marcescens* ShlB protein is an outer membrane protein, which is required for secretion and activation of the hemolysin structural protein, ShlA (Konninger et al., 1999). Once secreted, ShlA interacts with target cell membranes, oligomerizes, and forms pores on the cell membrane resulting in target cell lysis similar to other members of the "RTX" toxin family (Schönherr et al., 1994).

*H. ducreyi* strains expressing cloned hemolysin genes showed a ten-fold increase in invasion of human epithelial cells when compared to the control strain (Wood et al., 1999). The target cell range of *H. ducreyi* hemolysin includes T-cells, macrophages, human foreskin fibroblasts, human foreskin epithelial cells and B cells. PMNs were relatively insensitive to lysis by hemolysin (Wood et al., 1999). Secretion and activation of hemolysin by pathogenic bacteria is tightly regulated by iron.

Opacity Associated Protein

The opacity-associated proteins (OapA and OapB) have been implicated in phase variation, adhesion to epithelial cells during initial colonization and cell invasion in *H. influenza* and *Neisseria gonorrae* (Weiser et al., 1995; Blake and Gotschich 1984). *H. parsuis* ST5 and variant ST4 isolates encode two OapA and OapB proteins (HPM_0924 and HPM_0925) which help in initial colonization and adhesion along with fimbriae/adhesins and pili complex loci (HPM_0366, (HPM_0367, HPM_0368, HPM_0371, HPM_1452, HPM_1455 and HPM_1637).

Toxin-Antitoxin System

*H. parsuis* ST4 and ST5 genomes encode numerous toxin-antitoxin systems (TAS) which are abundant, diverse, horizontally mobile genetic elements (Arcus et al., 2004; Buts et al., 2005; Zielenkiewicz and Ceglowski 2001). TAS are mostly limited to bacterial and archaeal genomes and are involved in a variety of functions, including plasmid stabilization, transcription regulation, enhancing resistance mechanisms and RNA-interference (Pandey et al., 2005; Buts et al., 2005; Zielenkiewicz and Ceglowski 2001). *H. parsuis* ST4 and ST5 TAS modules include the host-death prevention family protein/antitoxin of toxin-antitoxin stability system (HPM_1007), antitoxin/toxin system zeta toxin, signal recognition particle GTPase protein (HPM_1145), fic family toxin-antitoxin (HPM_1182), addiction module antitoxin/putative RelE toxin-like protein, plasmid stabilization system (HPM_1184), toxin component RelE family (HPM_0312), transcriptional regulator/antitoxin, MazE protein (HPM_1226), antitoxin ChpS/transcriptional regulator/antitoxin, MazE/putative plasmid stable inheritance protein (HPM_1862), growth inhibitor, PemK-like autoregulated/transcriptional modulator of MazE/toxin, MazF, plasmid stable inheritance protein K protein (HPM_1863), plasmid stability protein StbD (HPM_2272), HicA and B (HPM_2185, HPM_0011 and HPM_0012). The number of modules in a TAS may range from one to eight (Mittenhuber 1999; Gerdes 2000). Most of the regulated TSS are two-component systems and function similar to HicA and HicB. The ORFs HicA and B (HPM_0011 and HPM_0012) are contiguous and attached to competence protein comM (HPM_0013), whereas another HicA (HPM_2185) is associated with an endonuclease (HPM_2184). The HicB protein has a partially degraded RNAse H fold, whereas HicA contains a double-stranded RNA-binding domain (Markarova et al., 2006). The stable combination of these two domains clearly suggests transcription regulation mediated through RNA, most probably by RNA binding-degradation (i.e., RNA interference) mechanism. In most HicB proteins, the RNAse H-like domain is fused to a DNA-binding domain, of the ribbon-helix-helix or to the helix-turn-helix motif. The TAS proteins containing these DNA-binding domains function as antitoxins (Markarova et al., 2006). *H. parasuis* ST4 and ST5 isolates have numerous TAS genes located within their pathogenicity islands (PAIS) that are amenable for horizontal transfer and function as accessory to chief virulence genes.

Virulence Associated Protein D

*H. parasuis* ST4 and ST5 genomes encode virulence associated protein D (VapD; HPM_1572) which shows 100% identity to VapD of *H. parasuis* SH0165 (YP_002476324), *H. parasuis* ZJ0906 (YP_008124455) and *H. parasuis* SW114 (EQA00157.1), but are only 90% identical to *Actinobacillus minor* (WP_005826028), 64% identical to *Neisseria lactamica* (WP_003711106.1), 63% identical to *N. meningitides* (WP_002238271.1), and 62% identical to a CRISPR associated Cas2 family protein of *N. meningitides* (WP_002251489). *Rhodococcus equi* isolated from foals contains a highly characterized vapD gene on an 80-90 kb virulence plasmid (Giguere et al., 1999). The *R. equi* virulence plasmid contains a 27.5 kb pathogenicity island encoding a family of seven Vap proteins including VapA-G (Jain et al., 2003). *R. equi* mutants lacking 7.9 kb DNA region spanning five vap genes (vapA, -C, -D, -E and -F) are avirulent and rapidly cleared by the mouse immune system compared to wild type (Jain et al., 2003). Furthermore, isogenic plasmid-cured mutants of *R. equi* strains lose their ability to survive in alveolar macrophages and fail to induce pneumonia in foals (Hondalus and Mosser, 1994; Hondalus 1997). The vap genes are also induced by $H_2O_2$ (Benoit et al., 2002). The VapD protein along with macrophage infectivity potentiator may be involved in initiating and maintaining *H. parasuis* intracellular infection, especially within macrophages. Therefore these antigens could be incorporated in a novel vaccine development strategy.

Colicin

Colicins are heat-labile proteins first identified in certain strains of *Escherichia coli* that harbor one colicinogenic plasmid (Feldgarden and Riley, 1999). Colicins have since been identified in many bacterial strains antagonistic to another closely related strain. Colicinogenic strains of pathogenic bacteria are widely distributed in nature and are particularly abundant in the guts of animals (Cascales et al., 2007). *H. parasuis* ST4 and ST5 colicins are not synthesized under normal conditions since the colicin operon is repressed by LexA protein (HPM_1027). *H. parasuis* ST4 and ST5 encode colicin V (HPM_1084) and a colicin transport protein TolQ (HPM_1307) conferring to these strains a competitive advantage in occupying the nasal cavities and the upper respiratory tract of pigs.

Cytolethal Distending Toxins (CTDs)

Cytolethal distending toxins have been identified in various gram negative bacteria including *Campylobacter* spp. (ref), *E. coli* (ref), *Haemophilus ducreyi* (ref), *Actinobacillus actinomycetemcomitans* (ref), *Shigella dysenteriae* (ref), and *Helicobacter* spp. (ref). CDTs are heterotrimeric toxins (Johnson et al., 1988; Picket t et al., 1994; Cope et al., 1997; Mayer et al., 1999; Okuda et al., 1995; Young et al., 2000). Once CDTs enter the target cells, CTDs randomly nick cellular DNA, leading to apoptosis (Jinadasa et al., 2011). These toxins also trigger G2/M cell cycle arrest in specific mammalian cell lines, leading to enlarged or distended cells and cause necrosis (Elwell and Dreyfus 2000). The toxin is internalized via the Golgi complex and transported to the endoplasmic reticulum in a retrograde fashion similar to Cholera Toxin A1 (Teter et al., 2002). CDT production is dependent on the expression of three contiguous genes (cdtA, cdtB, and cdtC) in the operon (Matsuda et al., 2008; Dreyfus 2003). However, *H. parasuis* ST4 and ST5 genomes contain one only gene encoding CTD internalizing protein (cdtA; HPA_2217), but lack the active toxin cdtB and an internalizing protein, cdtC. The possible reasons for missing cdtB and cdtC genes include a gap in the map-based assembly or they may lack a functional CTD operon. In human infections CDT-negative *Campylobacter* strains have been isolated from patients suffering with enteric disease, indicating that CDT expression may be inconsequential for virulence (Abuoun et al., 2005), similar to virulent *H. parasuis* ST4 strains.

Unmapped Genes

Analysis of the unmapped regions yielded 263 genes for ST4-1 (i.e., SEQ ID NO. 2) and 323 genes for ST4-2 (i.e., SEQ ID NO. 3) (data not shown). ORFs less than 300 base pairs are usually repeats and often do not encode any functional proteins. Therefore, a cut off value of 300 base pairs was set and ORFs ≥300 base pairs were mapped and annotated. This yielded 190 ORFs for ST4-1 (i.e., SEQ ID NO. 2) and 237 ORFs for ST4-2 (i.e., SEQ ID NO. 3). The unmapped regions of ST4-1 (i.e., SEQ ID NO. 2) and ST4-2 (i.e., SEQ ID NO. 3) contain horizontal gene transfer elements, hypothetical proteins, transcription factors, phage genomes, transporters, housekeeping genes (cell wall/LPS biosynthesis) and a toxin antitoxin protein zeta toxin. The uniqueness of these genes to each strain could not be verified since this was a map-based assembly on draft genomes.

Single Nucleotide Polymorphisms (SNPs)

We identified 40,000+ synonymous and nonsynonymous SNPs across all 3 isolates (data not shown). These SNPs span known virulence genes, virulence-associated genes and house-keeping genes. This data will be used to design SNP arrays that will aid in studying variation across strains and will potentially aid in understanding gene regulation and the mode of action of various virulence factors.

Taken together, comparative genomic analysis indicates that the variant *H. parasuis* ST4-1 (i.e., SEQ ID NO. 2) and ST4-2 (i.e., SEQ ID NO. 3) strains have extensive LOS and OMP structure modifications which aid in nasal colonization, host immune evasion and possibly afford serum resistance. Furthermore, the lack of sialic acid residues on OMP and LOS causes uncontrolled release of cytokines leading to septicemia, pulmonary edema and severe pneumonia, as indicated by the lung pathology. When piglets were challenged with variant *H. parasuis* ST4, 50% of them died within 48 hours. Clearly, the variant ST4 strain is highly virulent. The variant *H. parasuis* ST4 also possesses a more diverse repertoire of virulence and virulence associated genes than previously described. The combination of capsule modification and phase variation due to LOS substitutions would help variant *H. parasuis* ST4 escape host immune system and morph into a deadly pathogen which may lead to an outbreak.

The present invention may be embodied in other specific forms without departing from the spirit or essential attributes thereof, and it is therefore desired that the present embodiment be considered in all respects as illustrative and not restrictive, reference being made to the appended claims rather than to the foregoing description to indicate the scope of the invention.

SEQUENCE LISTING (3 sequences)

SEQ ID NO: 1 - DNA, 2216818 bp, Haemophilus parasuis
  misc_feature (2195)..(2294): n is a, c, g, or t
  misc_feature (4640)..(4739): n is a, c, g, or t
  misc_feature (6005)..(6104): n is a, c, g, or t
  misc_feature (12168)..(12267): n is a, c, g, or t
  misc_feature (12729)..(12828): n is a, c, g, or t
  misc_feature (14618)..(14717): n is a, c, g, or t
  misc_feature (15240)..(15339): n is a, c, g, or t
  misc_feature (19499)..(19598): n is a, c, g, or t
  misc_feature (26142)..(26241): n is a, c, g, or t
  misc_feature (26672)..(26771): n is a, c, g, or t
  misc_feature (27954)..(28053): n is a, c, g, or t
  misc_feature (28867)..(28966): n is a, c, g, or t
  misc_feature (29336)..(29435): n is a, c, g, or t
  misc_feature (30184)..(30283): n is a, c, g, or t
  misc_feature (35834)..(35933): n is a, c, g, or t
  misc_feature (38307)..(38406): n is a, c, g, or t
  misc_feature (40120)..(40219): n is a, c, g, or t
  misc_feature (40762)..(40861): n is a, c, g, or t
  misc_feature (41315)..(41414): n is a, c, g, or t
  misc_feature (44947)..(45046): n is a, c, g, or t
  misc_feature (46634)..(46733): n is a, c, g, or t
  misc_feature (52426)..(52525): n is a, c, g, or t
  misc_feature (55929)..(56028): n is a, c, g, or t
  misc_feature (64062)..(64161): n is a, c, g, or t
  misc_feature (66336)..(66435): n is a, c, g, or t
  misc_feature (67187)..(67286): n is a, c, g, or t
  misc_feature (69172)..(69271): n is a, c, g, or t
  misc_feature (69818)..(69917): n is a, c, g, or t
  misc_feature (70331)..(70430): n is a, c, g, or t
  misc_feature (70759)..(70858): n is a, c, g, or t
  misc_feature (72602)..(72701): n is a, c, g, or t
  misc_feature (76298)..(76397): n is a, c, g, or t
  misc_feature (79914)..(80013): n is a, c, g, or t
  misc_feature (80606)..(80705): n is a, c, g, or t
  misc_feature (82810)..(82909): n is a, c, g, or t
  misc_feature (85989)..(86088): n is a, c, g, or t
  misc_feature (86382)..(86481): n is a, c, g, or t
  misc_feature (90973)..(91072): n is a, c, g, or t
  misc_feature (92954)..(93053): n is a, c, g, or t
  misc_feature (98248)..(98347): n is a, c, g, or t
  misc_feature (99267)..(99366): n is a, c, g, or t
  misc_feature (99821)..(99920): n is a, c, g, or t
  misc_feature (102805)..(102904): n is a, c, g, or t
  misc_feature (104051)..(104150): n is a, c, g, or t
  misc_feature (108168)..(108267): n is a, c, g, or t
  misc_feature (112958)..(113057): n is a, c, g, or t
  misc_feature (115568)..(115667): n is a, c, g, or t
  misc_feature (115947)..(116046): n is a, c, g, or t
  misc_feature (116423)..(116522): n is a, c, g, or t
  misc_feature (116848)..(116947): n is a, c, g, or t
  misc_feature (120500)..(120599): n is a, c, g, or t
  misc_feature (122368)..(122467): n is a, c, g, or t
  misc_feature (125427)..(125526): n is a, c, g, or t
  misc_feature (127476)..(127575): n is a, c, g, or t
  misc_feature (129093)..(129192): n is a, c, g, or t
  misc_feature (130337)..(130436): n is a, c, g, or t
  misc_feature (130704)..(130803): n is a, c, g, or t
  misc_feature (131035)..(131134): n is a, c, g, or t
  misc_feature (132276)..(132375): n is a, c, g, or t
  misc_feature (135611)..(135710): n is a, c, g, or t
  misc_feature (136498)..(136597): n is a, c, g, or t
  misc_feature (139676)..(139775): n is a, c, g, or t
  misc_feature (141253)..(141352): n is a, c, g, or t
  misc_feature (144097)..(144196): n is a, c, g, or t
  misc_feature (145102)..(145201): n is a, c, g, or t
  misc_feature (145593)..(145692): n is a, c, g, or t
  misc_feature (149794)..(149893): n is a, c, g, or t
  misc_feature (150176)..(150275): n is a, c, g, or t
  misc_feature (150646)..(150745): n is a, c, g, or t
  misc_feature (151063)..(151162): n is a, c, g, or t
  misc_feature (152340)..(152439): n is a, c, g, or t
  misc_feature (154412)..(154511): n is a, c, g, or t
  misc_feature (155177)..(155276): n is a, c, g, or t
  misc_feature (157339)..(157438): n is a, c, g, or t
  misc_feature (159566)..(159665): n is a, c, g, or t
  misc_feature (160119)..(160218): n is a, c, g, or t
  misc_feature (161478)..(161577): n is a, c, g, or t
  misc_feature (163844)..(163943): n is a, c, g, or t
  misc_feature (164666)..(164765): n is a, c, g, or t
  misc_feature (167535)..(167634): n is a, c, g, or t
  misc_feature (171492)..(171591): n is a, c, g, or t
  misc_feature (174569)..(174668): n is a, c, g, or t
  misc_feature (175487)..(175586): n is a, c, g, or t
  misc_feature (176717)..(176816): n is a, c, g, or t
  misc_feature (177295)..(177394): n is a, c, g, or t
  misc_feature (177635)..(177734): n is a, c, g, or t
  misc_feature (178417)..(178516): n is a, c, g, or t
  misc_feature (181233)..(181332): n is a, c, g, or t
  misc_feature (181554)..(181653): n is a, c, g, or t
  misc_feature (181900)..(181999): n is a, c, g, or t
  misc_feature (185708)..(185807): n is a, c, g, or t
  misc_feature (188073)..(188172): n is a, c, g, or t
  misc_feature (189988)..(190087): n is a, c, g, or t
  misc_feature (194064)..(194163): n is a, c, g, or t
  misc_feature (195985)..(196084): n is a, c, g, or t
  misc_feature (203434)..(203533): n is a, c, g, or t
  misc_feature (204545)..(204644): n is a, c, g, or t
  misc_feature (205265)..(205364): n is a, c, g, or t
  misc_feature (208499)..(208598): n is a, c, g, or t
  misc_feature (210043)..(210142): n is a, c, g, or t
  misc_feature (215313)..(215412): n is a, c, g, or t
  misc_feature (222310)..(222409): n is a, c, g, or t
  misc_feature (222645)..(222744): n is a, c, g, or t
  misc_feature (223037)..(223136): n is a, c, g, or t
  misc_feature (223421)..(223520): n is a, c, g, or t
  misc_feature (230368)..(230467): n is a, c, g, or t
  misc_feature (231882)..(231981): n is a, c, g, or t
  misc_feature (234619)..(234718): n is a, c, g, or t
  misc_feature (245024)..(245123): n is a, c, g, or t
  misc_feature (247381)..(247480): n is a, c, g, or t
  misc_feature (255046)..(255145): n is a, c, g, or t
  misc_feature (261226)..(261325): n is a, c, g, or t
  misc_feature (270461)..(270560): n is a, c, g, or t
  misc_feature (270820)..(270919): n is a, c, g, or t
  misc_feature (276390)..(276489): n is a, c, g, or t
  misc_feature (276876)..(276975): n is a, c, g, or t
  misc_feature (277603)..(277702): n is a, c, g, or t
  misc_feature (278706)..(278805): n is a, c, g, or t
  misc_feature (281521)..(281620): n is a, c, g, or t
  misc_feature (281828)..(281927): n is a, c, g, or t
  misc_feature (282778)..(282877): n is a, c, g, or t
  misc_feature (283250)..(283349): n is a, c, g, or t
  misc_feature (283653)..(283752): n is a, c, g, or t
  misc_feature (284189)..(284288): n is a, c, g, or t
  misc_feature (290730)..(290829): n is a, c, g, or t
  misc_feature (293801)..(293900): n is a, c, g, or t
  misc_feature (299832)..(299931): n is a, c, g, or t
  misc_feature (302426)..(302525): n is a, c, g, or t
  misc_feature (303219)..(303318): n is a, c, g, or t
  misc_feature (303542)..(303641): n is a, c, g, or t
  misc_feature (305848)..(305947): n is a, c, g, or t
  misc_feature (307145)..(307244): n is a, c, g, or t
  misc_feature (308216)..(308315): n is a, c, g, or t
  misc_feature (309993)..(310092): n is a, c, g, or t
  misc_feature (312837)..(312936): n is a, c, g, or t
  misc_feature (318060)..(318159): n is a, c, g, or t
  misc_feature (318517)..(318616): n is a, c, g, or t
  misc_feature (320167)..(320266): n is a, c, g, or t
  misc_feature (325488)..(325587): n is a, c, g, or t
  misc_feature (327151)..(327250): n is a, c, g, or t
  misc_feature (332349)..(332448): n is a, c, g, or t
  misc_feature (332677)..(332776): n is a, c, g, or t
  misc_feature (336248)..(336347): n is a, c, g, or t
  misc_feature (338989)..(339088): n is a, c, g, or t
  misc_feature (341024)..(341123): n is a, c, g, or t
  misc_feature (342415)..(342514): n is a, c, g, or t
  misc_feature (343146)..(343245): n is a, c, g, or t
  misc_feature (346445)..(346544): n is a, c, g, or t
  misc_feature (346984)..(347083): n is a, c, g, or t
  misc_feature (348954)..(349053): n is a, c, g, or t
  misc_feature (349515)..(349614): n is a, c, g, or t
  misc_feature (351072)..(351171): n is a, c, g, or t
  misc_feature (353346)..(353445): n is a, c, g, or t
  misc_feature (357698)..(357797): n is a, c, g, or t
  misc_feature (361897)..(361996): n is a, c, g, or t
  misc_feature (365484)..(365583): n is a, c, g, or t
  misc_feature (375583)..(375682): n is a, c, g, or t
  misc_feature (384014)..(384113): n is a, c, g, or t
  misc_feature (386540)..(386639): n is a, c, g, or t
  misc_feature (388646)..(388745): n is a, c, g, or t
  misc_feature (389103)..(389202): n is a, c, g, or t
  misc_feature (390435)..(390534): n is a, c, g, or t
  misc_feature (390886)..(390985): n is a, c, g, or t
  misc_feature (391252)..(391351): n is a, c, g, or t
  misc_feature (391600)..(391699): n is a, c, g, or t
  misc_feature (394217)..(394316): n is a, c, g, or t
  misc_feature (396813)..(396912): n is a, c, g, or t
  misc_feature (400876)..(400975): n is a, c, g, or t
  misc_feature (408570)..(408669): n is a, c, g, or t
  misc_feature (409859)..(409958): n is a, c, g, or t
  misc_feature (410974)..(411073): n is a, c, g, or t
  misc_feature (411619)..(411718): n is a, c, g, or t
  misc_feature (412297)..(412396): n is a, c, g, or t
  misc_feature (413757)..(413856): n is a, c, g, or t
  misc_feature (425492)..(425591): n is a, c, g, or t
  misc_feature (427707)..(427806): n is a, c, g, or t
  misc_feature (428669)..(428768): n is a, c, g, or t
  misc_feature (429003)..(429102): n is a, c, g, or t
  misc_feature (430105)..(430204): n is a, c, g, or t
  misc_feature (431374)..(431473): n is a, c, g, or t
  misc_feature (432416)..(432515): n is a, c, g, or t
  misc_feature (434170)..(434269): n is a, c, g, or t
  misc_feature (442318)..(442417): n is a, c, g, or t
  misc_feature (445791)..(445890): n is a, c, g, or t
  misc_feature (447162)..(447261): n is a, c, g, or t
  misc_feature (452149)..(452248): n is a, c, g, or t
  misc_feature (454463)..(454562): n is a, c, g, or t
  misc_feature (455146)..(455245): n is a, c, g, or t
  misc_feature (458843)..(458942): n is a, c, g, or t
  misc_feature (470431)..(470530): n is a, c, g, or t
  misc_feature (476793)..(476892): n is a, c, g, or t
  misc_feature (478379)..(478478): n is a, c, g, or t
  misc_feature (480629)..(480728): n is a, c, g, or t
  misc_feature (484366)..(484465): n is a, c, g, or t
  misc_feature (488423)..(488522): n is a, c, g, or t
  misc_feature (491404)..(491503): n is a, c, g, or t
  misc_feature (499002)..(499101): n is a, c, g, or t
  misc_feature (501016)..(501115): n is a, c, g, or t
  misc_feature (504541)..(504640): n is a, c, g, or t
  misc_feature (505738)..(505837): n is a, c, g, or t
  misc_feature (507686)..(507785): n is a, c, g, or t
  misc_feature (508372)..(508471): n is a, c, g, or t
  misc_feature (508777)..(508876): n is a, c, g, or t
  misc_feature (509399)..(509498): n is a, c, g, or t
  misc_feature (510413)..(510512): n is a, c, g, or t
  misc_feature (514471)..(514570): n is a, c, g, or t
  misc_feature (518765)..(518864): n is a, c, g, or t
  misc_feature (519850)..(519949): n is a, c, g, or t
  misc_feature (520273)..(520372): n is a, c, g, or t
  misc_feature (527985)..(528084): n is a, c, g, or t
  misc_feature (528316)..(528415): n is a, c, g, or t
  misc_feature (534889)..(534988): n is a, c, g, or t
  misc_feature (535502)..(535601): n is a, c, g, or t
  misc_feature (537548)..(537647): n is a, c, g, or t
  misc_feature (539748)..(539847): n is a, c, g, or t
  misc_feature (540971)..(541070): n is a, c, g, or t
  misc_feature (541476)..(541575): n is a, c, g, or t
  misc_feature (542114)..(542213): n is a, c, g, or t
  misc_feature (542551)..(542650): n is a, c, g, or t
  misc_feature (544264)..(544363): n is a, c, g, or t
  misc_feature (544753)..(544852): n is a, c, g, or t
  misc_feature (551302)..(551401): n is a, c, g, or t
  misc_feature (552163)..(552262): n is a, c, g, or t
  misc_feature (552559)..(552658): n is a, c, g, or t
  misc_feature (553255)..(553354): n is a, c, g, or t
  misc_feature (553649)..(553748): n is a, c, g, or t
  misc_feature (557273)..(557372): n is a, c, g, or t
  misc_feature (563934)..(564033): n is a, c, g, or t
  misc_feature (567812)..(567911): n is a, c, g, or t
  misc_feature (572506)..(572605): n is a, c, g, or t
  misc_feature (572961)..(573060): n is a, c, g, or t
  misc_feature (574569)..(574668): n is a, c, g, or t
  misc_feature (574887)..(574986): n is a, c, g, or t
  misc_feature (576097)..(576196): n is a, c, g, or t
  misc_feature (576801)..(576900): n is a, c, g, or t
  misc_feature (577324)..(577423): n is a, c, g, or t
  misc_feature (577690)..(577789): n is a, c, g, or t
  misc_feature (579837)..(579936): n is a, c, g, or t
  misc_feature (580774)..(580873): n is a, c, g, or t
  misc_feature (581336)..(581435): n is a, c, g, or t
  misc_feature (583013)..(583112): n is a, c, g, or t
  misc_feature (586424)..(586523): n is a, c, g, or t
  misc_feature (586911)..(587010): n is a, c, g, or t
  misc_feature (587588)..(587687): n is a, c, g, or t
  misc_feature (587948)..(588047): n is a, c, g, or t
  misc_feature (589513)..(589612): n is a, c, g, or t
  misc_feature (593880)..(593979): n is a, c, g, or t
  misc_feature (595487)..(595586): n is a, c, g, or t
  misc_feature (597804)..(597903): n is a, c, g, or t
  misc_feature (599237)..(599336): n is a, c, g, or t
  misc_feature (601784)..(601883): n is a, c, g, or t
  misc_feature (602850)..(602949): n is a, c, g, or t
  misc_feature (605223)..(605322): n is a, c, g, or t
  misc_feature (605969)..(606068): n is a, c, g, or t
  misc_feature (606887)..(606986): n is a, c, g, or t
  misc_feature (609914)..(610013): n is a, c, g, or t
  misc_feature (615427)..(615526): n is a, c, g, or t
  misc_feature (617571)..(617670): n is a, c, g, or t
  misc_feature (622004)..(622103): n is a, c, g, or t
  misc_feature (622314)..(622413): n is a, c, g, or t
  misc_feature (623877)..(623976): n is a, c, g, or t
  misc_feature (630542)..(630641): n is a, c, g, or t
  misc_feature (630984)..(631083): n is a, c, g, or t
  misc_feature (632378)..(632477): n is a, c, g, or t
  misc_feature (636233)..(636332): n is a, c, g, or t
  misc_feature (638289)..(638388): n is a, c, g, or t
  misc_feature (639347)..(639446): n is a, c, g, or t
  misc_feature (640313)..(640412): n is a, c, g, or t
  misc_feature (641694)..(641793): n is a, c, g, or t
  misc_feature (645796)..(645895): n is a, c, g, or t
  misc_feature (649288)..(649387): n is a, c, g, or t
  misc_feature (649722)..(649821): n is a, c, g, or t
  misc_feature (651611)..(651710): n is a, c, g, or t
  misc_feature (664832)..(664931): n is a, c, g, or t
  misc_feature (666105)..(666204): n is a, c, g, or t
  misc_feature (669508)..(669607): n is a, c, g, or t
  misc_feature (669959)..(670058): n is a, c, g, or t
  misc_feature (674830)..(674929): n is a, c, g, or t
  misc_feature (675468)..(675567): n is a, c, g, or t
  misc_feature (677246)..(677345): n is a, c, g, or t
  misc_feature (677558)..(677657): n is a, c, g, or t
  misc_feature (681073)..(681172): n is a, c, g, or t
  misc_feature (687080)..(687179): n is a, c, g, or t
  misc_feature (688447)..(688546): n is a, c, g, or t
  misc_feature (689996)..(690095): n is a, c, g, or t
  misc_feature (691668)..(691767): n is a, c, g, or t
  misc_feature (692273)..(692372): n is a, c, g, or t
  misc_feature (693561)..(693660): n is a, c, g, or t
  misc_feature (695153)..(695252): n is a, c, g, or t
  misc_feature (696007)..(696106): n is a, c, g, or t
  misc_feature (700856)..(700955): n is a, c, g, or t
  misc_feature (703569)..(703668): n is a, c, g, or t
  misc_feature (704814)..(704913): n is a, c, g, or t
  misc_feature (705361)..(705460): n is a, c, g, or t
  misc_feature (705935)..(706034): n is a, c, g, or t
  misc_feature (709225)..(709324): n is a, c, g, or t
  misc_feature (709649)..(709748): n is a, c, g, or t
  misc_feature (710218)..(710317): n is a, c, g, or t
  misc_feature (711490)..(711589): n is a, c, g, or t
  misc_feature (713409)..(713508): n is a, c, g, or t
  misc_feature (716409)..(716508): n is a, c, g, or t
  misc_feature (719367)..(719466): n is a, c, g, or t
  misc_feature (723336)..(723435): n is a, c, g, or t
  misc_feature (725531)..(725630): n is a, c, g, or t
  misc_feature (727491)..(727590): n is a, c, g, or t
  misc_feature (732519)..(732618): n is a, c, g, or t
  misc_feature (734139)..(734238): n is a, c, g, or t
  misc_feature (736306)..(736405): n is a, c, g, or t
  misc_feature (736635)..(736734): n is a, c, g, or t
  misc_feature (737308)..(737407): n is a, c, g, or t
  misc_feature (738950)..(739049): n is a, c, g, or t
  misc_feature (743610)..(743709): n is a, c, g, or t
  misc_feature (746161)..(746260): n is a, c, g, or t
  misc_feature (747858)..(747957): n is a, c, g, or t
  misc_feature (750273)..(750372): n is a, c, g, or t
  misc_feature (751927)..(752026): n is a, c, g, or t
  misc_feature (752931)..(753030): n is a, c, g, or t
  misc_feature (765867)..(765966): n is a, c, g, or t
  misc_feature (766394)..(766493): n is a, c, g, or t
  misc_feature (769429)..(769528): n is a, c, g, or t
  misc_feature (769959)..(770058): n is a, c, g, or t
  misc_feature (771349)..(771448): n is a, c, g, or t
  misc_feature (771963)..(772062): n is a, c, g, or t
  misc_feature (775283)..(775382): n is a, c, g, or t
  misc_feature (780667)..(780766): n is a, c, g, or t
  misc_feature (785684)..(785783): n is a, c, g, or t
  misc_feature (786645)..(786744): n is a, c, g, or t
  misc_feature (788475)..(788574): n is a, c, g, or t
  misc_feature (789387)..(789486): n is a, c, g, or t
  misc_feature (790514)..(790613): n is a, c, g, or t
  misc_feature (793872)..(793971): n is a, c, g, or t
  misc_feature (794860)..(794959): n is a, c, g, or t
  misc_feature (795199)..(795298): n is a, c, g, or t
  misc_feature (795607)..(795706): n is a, c, g, or t
  misc_feature (796098)..(796197): n is a, c, g, or t
  misc_feature (796750)..(796849): n is a, c, g, or t
  misc_feature (797106)..(797205): n is a, c, g, or t
  misc_feature (797479)..(797578): n is a, c, g, or t
  misc_feature (798672)..(798771): n is a, c, g, or t
  misc_feature (802529)..(802628): n is a, c, g, or t
  misc_feature (804798)..(804897): n is a, c, g, or t
  misc_feature (808787)..(808886): n is a, c, g, or t
  misc_feature (811148)..(811247): n is a, c, g, or t
  misc_feature (811983)..(812082): n is a, c, g, or t
  misc_feature (815553)..(815652): n is a, c, g, or t
  misc_feature (815885)..(815984): n is a, c, g, or t
  misc_feature (818326)..(818425): n is a, c, g, or t
  misc_feature (819071)..(819170): n is a, c, g, or t
  misc_feature (823168)..(823267): n is a, c, g, or t
  misc_feature (828718)..(828817): n is a, c, g, or t
  misc_feature (829840)..(829939): n is a, c, g, or t
  misc_feature (830562)..(830661): n is a, c, g, or t
  misc_feature (831726)..(831825): n is a, c, g, or t
  misc_feature (836958)..(837057): n is a, c, g, or t
  misc_feature (838446)..(838545): n is a, c, g, or t
  misc_feature (839501)..(839600): n is a, c, g, or t
  misc_feature (839906)..(840005): n is a, c, g, or t
  misc_feature (840329)..(840428): n is a, c, g, or t
  misc_feature (841564)..(841663): n is a, c, g, or t
  misc_feature (850201)..(850300): n is a, c, g, or t
  misc_feature (850566)..(850665): n is a, c, g, or t
  misc_feature (857198)..(857297): n is a, c, g, or t
  misc_feature (859621)..(859720): n is a, c, g, or t
  misc_feature (864587)..(864686): n is a, c, g, or t
  misc_feature (865733)..(865832): n is a, c, g, or t
  misc_feature (871877)..(871976): n is a, c, g, or t
  misc_feature (872208)..(872307): n is a, c, g, or t
  misc_feature (872570)..(872669): n is a, c, g, or t
  misc_feature (875453)..(875552): n is a, c, g, or t
  misc_feature (884054)..(884153): n is a, c, g, or t
  misc_feature (884531)..(884630): n is a, c, g, or t
  misc_feature (884898)..(884997): n is a, c, g, or t
  misc_feature (894636)..(894735): n is a, c, g, or t
  misc_feature (897797)..(897896): n is a, c, g, or t
  misc_feature (898308)..(898407): n is a, c, g, or t
  misc_feature (899286)..(899385): n is a, c, g, or t
  misc_feature (902605)..(902704): n is a, c, g, or t
  misc_feature (905673)..(905772): n is a, c, g, or t
  misc_feature (906259)..(906358): n is a, c, g, or t
  misc_feature (911140)..(911239): n is a, c, g, or t
  misc_feature (911544)..(911643): n is a, c, g, or t
  misc_feature (913405)..(913504): n is a, c, g, or t
  misc_feature (916606)..(916705): n is a, c, g, or t
  misc_feature (921133)..(921232): n is a, c, g, or t
  misc_feature (924230)..(924329): n is a, c, g, or t
  misc_feature (927024)..(927123): n is a, c, g, or t
  misc_feature (927774)..(927873): n is a, c, g, or t
  misc_feature (928901)..(929000): n is a, c, g, or t
  misc_feature (931118)..(931217): n is a, c, g, or t
  misc_feature (931502)..(931601): n is a, c, g, or t
  misc_feature (936696)..(936795): n is a, c, g, or t
  misc_feature (940815)..(940914): n is a, c, g, or t
  misc_feature (941162)..(941261): n is a, c, g, or t
  misc_feature (943369)..(943468): n is a, c, g, or t
  misc_feature (944300)..(944399): n is a, c, g, or t
  misc_feature (948694)..(948793): n is a, c, g, or t
  misc_feature (949123)..(949222): n is a, c, g, or t
  misc_feature (949613)..(949712): n is a, c, g, or t
  misc_feature (951846)..(951945): n is a, c, g, or t
  misc_feature (952251)..(952350): n is a, c, g, or t
  misc_feature (955534)..(955633): n is a, c, g, or t
  misc_feature (956029)..(956128): n is a, c, g, or t
  misc_feature (957391)..(957490): n is a, c, g, or t
  misc_feature (964108)..(964207): n is a, c, g, or t
  misc_feature (967099)..(967198): n is a, c, g, or t
  misc_feature (967948)..(968047): n is a, c, g, or t
  misc_feature (969501)..(969600): n is a, c, g, or t
  misc_feature (972148)..(972247): n is a, c, g, or t
  misc_feature (973191)..(973290): n is a, c, g, or t
  misc_feature (973630)..(973729): n is a, c, g, or t
  misc_feature (974294)..(974393): n is a, c, g, or t
  misc_feature (974913)..(975012): n is a, c, g, or t
  misc_feature (976130)..(976229): n is a, c, g, or t
  misc_feature (978396)..(978495): n is a, c, g, or t
  misc_feature (978864)..(978963): n is a, c, g, or t
  misc_feature (984086)..(984185): n is a, c, g, or t
  misc_feature (985623)..(985722): n is a, c, g, or t
  misc_feature (986847)..(986946): n is a, c, g, or t
  misc_feature (989352)..(989451): n is a, c, g, or t
  misc_feature (992545)..(992644): n is a, c, g, or t
  misc_feature (993937)..(994036): n is a, c, g, or t
  misc_feature (997536)..(997635): n is a, c, g, or t
  misc_feature (1001502)..(1001601): n is a, c, g, or t
  misc_feature (1001904)..(1002003): n is a, c, g, or t
  misc_feature (1002332)..(1002431): n is a, c, g, or t
  misc_feature (1006267)..(1006366): n is a, c, g, or t
  misc_feature (1008772)..(1008871): n is a, c, g, or t
  misc_feature (1012354)..(1012453): n is a, c, g, or t
  misc_feature (1012848)..(1012947): n is a, c, g, or t
  misc_feature (1013235)..(1013334): n is a, c, g, or t
  misc_feature (1014028)..(1014127): n is a, c, g, or t
  misc_feature (1016359)..(1016458): n is a, c, g, or t
  misc_feature (1020262)..(1020361): n is a, c, g, or t
  misc_feature (1020894)..(1020993): n is a, c, g, or t
  misc_feature (1022416)..(1022515): n is a, c, g, or t
  misc_feature (1022882)..(1022981): n is a, c, g, or t
  misc_feature (1023408)..(1023507): n is a, c, g, or t
  misc_feature (1023956)..(1024055): n is a, c, g, or t
  misc_feature (1024985)..(1025084): n is a, c, g, or t
  misc_feature (1025350)..(1025449): n is a, c, g, or t
  misc_feature (1025741)..(1025840): n is a, c, g, or t
  misc_feature (1026664)..(1026763): n is a, c, g, or t
  misc_feature (1027036)..(1027135): n is a, c, g, or t
  misc_feature (1028144)..(1028243): n is a, c, g, or t
  misc_feature (1034549)..(1034648): n is a, c, g, or t
  misc_feature (1035908)..(1036007): n is a, c, g, or t
  misc_feature (1037164)..(1037263): n is a, c, g, or t
  misc_feature (1038744)..(1038843): n is a, c, g, or t
  misc_feature (1039947)..(1040046): n is a, c, g, or t
  misc_feature (1040432)..(1040531): n is a, c, g, or t
  misc_feature (1041788)..(1041887): n is a, c, g, or t
  misc_feature (1050437)..(1050536): n is a, c, g, or t
  misc_feature (1050943)..(1051042): n is a, c, g, or t
  misc_feature (1052889)..(1052988): n is a, c, g, or t
  misc_feature (1054083)..(1054182): n is a, c, g, or t
  misc_feature (1055684)..(1055783): n is a, c, g, or t
  misc_feature (1060091)..(1060190): n is a, c, g, or t
  misc_feature (1060704)..(1060803): n is a, c, g, or t
  misc_feature (1061288)..(1061387): n is a, c, g, or t
  misc_feature (1062570)..(1062669): n is a, c, g, or t
  misc_feature (1063265)..(1063364): n is a, c, g, or t
  misc_feature (1065587)..(1065686): n is a, c, g, or t
  misc_feature (1065903)..(1066002): n is a, c, g, or t
  misc_feature (1071374)..(1071473): n is a, c, g, or t
  misc_feature (1072288)..(1072387): n is a, c, g, or t
  misc_feature (1072690)..(1072789): n is a, c, g, or t
  misc_feature (1075843)..(1075942): n is a, c, g, or t
  misc_feature (1076209)..(1076308): n is a, c, g, or t
  misc_feature (1079724)..(1079823): n is a, c, g, or t
  misc_feature (1081176)..(1081275): n is a, c, g, or t
  misc_feature (1081852)..(1081951): n is a, c, g, or t
  misc_feature (1082432)..(1082531): n is a, c, g, or t
  misc_feature (1083291)..(1083390): n is a, c, g, or t
  misc_feature (1088330)..(1088429): n is a, c, g, or t
  misc_feature (1089329)..(1089428): n is a, c, g, or t
  misc_feature (1090900)..(1090999): n is a, c, g, or t
  misc_feature (1091458)..(1091557): n is a, c, g, or t
  misc_feature (1092079)..(1092178): n is a, c, g, or t
  misc_feature (1093397)..(1093496): n is a, c, g, or t
  misc_feature (1095608)..(1095707): n is a, c, g, or t
  misc_feature (1102835)..(1102934): n is a, c, g, or t
  misc_feature (1103370)..(1103469): n is a, c, g, or t
  misc_feature (1105813)..(1105912): n is a, c, g, or t
  misc_feature (1107888)..(1107987): n is a, c, g, or t
  misc_feature (1109152)..(1109251): n is a, c, g, or t
  misc_feature (1109501)..(1109600): n is a, c, g, or t
  misc_feature (1115799)..(1115898): n is a, c, g, or t
  misc_feature (1116272)..(1116371): n is a, c, g, or t
  misc_feature (1119920)..(1120019): n is a, c, g, or t
  misc_feature (1125960)..(1126059): n is a, c, g, or t
  misc_feature (1128537)..(1128636): n is a, c, g, or t
  misc_feature (1135500)..(1135599): n is a, c, g, or t
  misc_feature (1140771)..(1140870): n is a, c, g, or t
  misc_feature (1141406)..(1141505): n is a, c, g, or t
  misc_feature (1144852)..(1144951): n is a, c, g, or t
  misc_feature (1145965)..(1146064): n is a, c, g, or t
  misc_feature (1151433)..(1151532): n is a, c, g, or t
  misc_feature (1157946)..(1158045): n is a, c, g, or t
  misc_feature (1167611)..(1167710): n is a, c, g, or t
  misc_feature (1168783)..(1168882): n is a, c, g, or t
  misc_feature (1171112)..(1171211): n is a, c, g, or t
  misc_feature (1178318)..(1178417): n is a, c, g, or t
  misc_feature (1179777)..(1179876): n is a, c, g, or t
  misc_feature (1180402)..(1180501): n is a, c, g, or t
  misc_feature (1182503)..(1182602): n is a, c, g, or t
  misc_feature (1185068)..(1185167): n is a, c, g, or t
  misc_feature (1187609)..(1187708): n is a, c, g, or t
  misc_feature (1191253)..(1191352): n is a, c, g, or t
  misc_feature (1193898)..(1193997): n is a, c, g, or t
  misc_feature (1194340)..(1194439): n is a, c, g, or t
  misc_feature (1194762)..(1194861): n is a, c, g, or t
  misc_feature (1195063)..(1195162): n is a, c, g, or t
  misc_feature (1195722)..(1195821): n is a, c, g, or t
  misc_feature (1196022)..(1196121): n is a, c, g, or t
  misc_feature (1203176)..(1203275): n is a, c, g, or t
  misc_feature (1203972)..(1204071): n is a, c, g, or t
  misc_feature (1205109)..(1205208): n is a, c, g, or t
  misc_feature (1209889)..(1209988): n is a, c, g, or t
  misc_feature (1210759)..(1210858): n is a, c, g, or t
  misc_feature (1211807)..(1211906): n is a, c, g, or t
  misc_feature (1212996)..(1213095): n is a, c, g, or t
  misc_feature (1217153)..(1217252): n is a, c, g, or t
  misc_feature (1222593)..(1222692): n is a, c, g, or t
  misc_feature (1224146)..(1224245): n is a, c, g, or t
  misc_feature (1227603)..(1227702): n is a, c, g, or t
  misc_feature (1235519)..(1235618): n is a, c, g, or t
  misc_feature (1236750)..(1236849): n is a, c, g, or t
  misc_feature (1239381)..(1239480): n is a, c, g, or t
  misc_feature (1242917)..(1243016): n is a, c, g, or t
  misc_feature (1244018)..(1244117): n is a, c, g, or t
  misc_feature (1247814)..(1247913): n is a, c, g, or t
  misc_feature (1248329)..(1248428): n is a, c, g, or t
  misc_feature (1249034)..(1249133): n is a, c, g, or t
  misc_feature (1249489)..(1249588): n is a, c, g, or t
  misc_feature (1250643)..(1250742): n is a, c, g, or t
  misc_feature (1252262)..(1252361): n is a, c, g, or t
  misc_feature (1252628)..(1252727): n is a, c, g, or t
  misc_feature (1253475)..(1253574): n is a, c, g, or t
  misc_feature (1255729)..(1255828): n is a, c, g, or t
  misc_feature (1256490)..(1256589): n is a, c, g, or t
  misc_feature (1257847)..(1257946): n is a, c, g, or t
  misc_feature (1259143)..(1259242): n is a, c, g, or t
  misc_feature (1259623)..(1259722): n is a, c, g, or t
  misc_feature (1264142)..(1264241): n is a, c, g, or t
  misc_feature (1265110)..(1265209): n is a, c, g, or t
  misc_feature (1265475)..(1265574): n is a, c, g, or t
  misc_feature (1265966)..(1266065): n is a, c, g, or t
  misc_feature (1268235)..(1268334): n is a, c, g, or t
  misc_feature (1271088)..(1271187): n is a, c, g, or t
  misc_feature (1274181)..(1274280): n is a, c, g, or t
  misc_feature (1275411)..(1275510): n is a, c, g, or t
  misc_feature (1280870)..(1280969): n is a, c, g, or t
  misc_feature (1281559)..(1281658): n is a, c, g, or t
  misc_feature (1282019)..(1282118): n is a, c, g, or t
  misc_feature (1282962)..(1283061): n is a, c, g, or t
  misc_feature (1284414)..(1284513): n is a, c, g, or t
  misc_feature (1284872)..(1284971): n is a, c, g, or t
  misc_feature (1286930)..(1287029): n is a, c, g, or t
  misc_feature (1287549)..(1287648): n is a, c, g, or t
  misc_feature (1289107)..(1289206): n is a, c, g, or t
  misc_feature (1290948)..(1291047): n is a, c, g, or t
  misc_feature (1291328)..(1291427): n is a, c, g, or t
  misc_feature (1292569)..(1292668): n is a, c, g, or t
  misc_feature (1294899)..(1294998): n is a, c, g, or t
  misc_feature (1296165)..(1296264): n is a, c, g, or t
  misc_feature (1297355)..(1297454): n is a, c, g, or t
  misc_feature (1299532)..(1299631): n is a, c, g, or t
  misc_feature (1300884)..(1300983): n is a, c, g, or t
  misc_feature (1306357)..(1306456): n is a, c, g, or t
  misc_feature (1307222)..(1307321): n is a, c, g, or t
  misc_feature (1307827)..(1307926): n is a, c, g, or t
  misc_feature (1310179)..(1310278): n is a, c, g, or t
  misc_feature (1311486)..(1311585): n is a, c, g, or t
  misc_feature (1312507)..(1312606): n is a, c, g, or t
  misc_feature (1314633)..(1314732): n is a, c, g, or t
  misc_feature (1317309)..(1317408): n is a, c, g, or t
  misc_feature (1318168)..(1318267): n is a, c, g, or t
  misc_feature (1318622)..(1318721): n is a, c, g, or t
  misc_feature (1320780)..(1320879): n is a, c, g, or t
  misc_feature (1324979)..(1325078): n is a, c, g, or t
  misc_feature (1325488)..(1325587): n is a, c, g, or t
  misc_feature (1327217)..(1327316): n is a, c, g, or t
  misc_feature (1330380)..(1330479): n is a, c, g, or t
  misc_feature (1331581)..(1331680): n is a, c, g, or t
  misc_feature (1337428)..(1337527): n is a, c, g, or t
  misc_feature (1340368)..(1340467): n is a, c, g, or t
  misc_feature (1346065)..(1346164): n is a, c, g, or t
  misc_feature (1349414)..(1349513): n is a, c, g, or t
  misc_feature (1350371)..(1350470): n is a, c, g, or t
  misc_feature (1354400)..(1354499): n is a, c, g, or t
  misc_feature (1355511)..(1355610): n is a, c, g, or t
  misc_feature (1357886)..(1357985): n is a, c, g, or t
  misc_feature (1358336)..(1358435): n is a, c, g, or t
  misc_feature (1359103)..(1359202): n is a, c, g, or t
  misc_feature (1359785)..(1359884): n is a, c, g, or t
  misc_feature (1360124)..(1360223): n is a, c, g, or t
  misc_feature (1361839)..(1361938): n is a, c, g, or t
  misc_feature (1364146)..(1364245): n is a, c, g, or t
  misc_feature (1365694)..(1365793): n is a, c, g, or t
  misc_feature (1367801)..(1367900): n is a, c, g, or t
  misc_feature (1369636)..(1369735): n is a, c, g, or t
  misc_feature (1369954)..(1370053): n is a, c, g, or t
  misc_feature (1371165)..(1371264): n is a, c, g, or t
  misc_feature (1371784)..(1371883): n is a, c, g, or t
  misc_feature (1372472)..(1372571): n is a, c, g, or t
  misc_feature (1374819)..(1374918): n is a, c, g, or t
  misc_feature (1378831)..(1378930): n is a, c, g, or t
  misc_feature (1380159)..(1380258): n is a, c, g, or t
  misc_feature (1381759)..(1381858): n is a, c, g, or t
  misc_feature (1382086)..(1382185): n is a, c, g, or t
  misc_feature (1385753)..(1385852): n is a, c, g, or t
  misc_feature (1387306)..(1387405): n is a, c, g, or t
  misc_feature (1388601)..(1388700): n is a, c, g, or t
  misc_feature (1388951)..(1389050): n is a, c, g, or t
  misc_feature (1391390)..(1391489): n is a, c, g, or t
  misc_feature (1392991)..(1393090): n is a, c, g, or t
  misc_feature (1397427)..(1397526): n is a, c, g, or t
  misc_feature (1397842)..(1397941): n is a, c, g, or t
  misc_feature (1398905)..(1399004): n is a, c, g, or t
  misc_feature (1400568)..(1400667): n is a, c, g, or t
  misc_feature (1402247)..(1402346): n is a, c, g, or t
  misc_feature (1402597)..(1402696): n is a, c, g, or t
  misc_feature (1407659)..(1407758): n is a, c, g, or t
  misc_feature (1408739)..(1408838): n is a, c, g, or t
  misc_feature (1410212)..(1410311): n is a, c, g, or t
  misc_feature (1410768)..(1410867): n is a, c, g, or t
  misc_feature (1411759)..(1411858): n is a, c, g, or t
  misc_feature (1412667)..(1412766): n is a, c, g, or t
  misc_feature (1413618)..(1413717): n is a, c, g, or t
  misc_feature (1415236)..(1415335): n is a, c, g, or t
  misc_feature (1418517)..(1418616): n is a, c, g, or t
  misc_feature (1419824)..(1419923): n is a, c, g, or t
  misc_feature (1420769)..(1420868): n is a, c, g, or t
  misc_feature (1424092)..(1424191): n is a, c, g, or t
  misc_feature (1428193)..(1428292): n is a, c, g, or t
  misc_feature (1433816)..(1433915): n is a, c, g, or t
  misc_feature (1437898)..(1437997): n is a, c, g, or t
  misc_feature (1440192)..(1440291): n is a, c, g, or t
  misc_feature (1443543)..(1443642): n is a, c, g, or t
  misc_feature (1448443)..(1448542): n is a, c, g, or t
  misc_feature (1450023)..(1450122): n is a, c, g, or t
  misc_feature (1451000)..(1451099): n is a, c, g, or t
  misc_feature (1454844)..(1454943): n is a, c, g, or t
  misc_feature (1459466)..(1459565): n is a, c, g, or t
  misc_feature (1459833)..(1459932): n is a, c, g, or t
  misc_feature (1460351)..(1460450): n is a, c, g, or t
  misc_feature (1464273)..(1464372): n is a, c, g, or t
  misc_feature (1465843)..(1465942): n is a, c, g, or t
  misc_feature (1467896)..(1467995): n is a, c, g, or t
  misc_feature (1468805)..(1468904): n is a, c, g, or t
  misc_feature (1470189)..(1470288): n is a, c, g, or t
  misc_feature (1470924)..(1471023): n is a, c, g, or t
  misc_feature (1471298)..(1471397): n is a, c, g, or t
  misc_feature (1471665)..(1471764): n is a, c, g, or t
  misc_feature (1474369)..(1474468): n is a, c, g, or t
  misc_feature (1475018)..(1475117): n is a, c, g, or t
  misc_feature (1475645)..(1475744): n is a, c, g, or t
  misc_feature (1480767)..(1480866): n is a, c, g, or t
  misc_feature (1482523)..(1482622): n is a, c, g, or t
  misc_feature (1484766)..(1484865): n is a, c, g, or t
  misc_feature (1485903)..(1486002): n is a, c, g, or t
  misc_feature (1486292)..(1486391): n is a, c, g, or t
  misc_feature (1490963)..(1491062): n is a, c, g, or t
  misc_feature (1491336)..(1491435): n is a, c, g, or t
  misc_feature (1492172)..(1492271): n is a, c, g, or t
  misc_feature (1492767)..(1492866): n is a, c, g, or t
  misc_feature (1493498)..(1493597): n is a, c, g, or t
  misc_feature (1500236)..(1500335): n is a, c, g, or t
  misc_feature (1500743)..(1500842): n is a, c, g, or t
  misc_feature (1502588)..(1502687): n is a, c, g, or t
  misc_feature (1503114)..(1503213): n is a, c, g, or t
  misc_feature (1505807)..(1505906): n is a, c, g, or t
  misc_feature (1507962)..(1508061): n is a, c, g, or t
  misc_feature (1508603)..(1508702): n is a, c, g, or t
  misc_feature (1511127)..(1511226): n is a, c, g, or t
  misc_feature (1511979)..(1512078): n is a, c, g, or t
  misc_feature (1512742)..(1512841): n is a, c, g, or t
  misc_feature (1513335)..(1513434): n is a, c, g, or t
  misc_feature (1515633)..(1515732): n is a, c, g, or t
  misc_feature (1518551)..(1518650): n is a, c, g, or t
  misc_feature (1522790)..(1522889): n is a, c, g, or t
  misc_feature (1523175)..(1523274): n is a, c, g, or t
  misc_feature (1523912)..(1524011): n is a, c, g, or t
  misc_feature (1527240)..(1527339): n is a, c, g, or t
  misc_feature (1527561)..(1527660): n is a, c, g, or t
  misc_feature (1530136)..(1530235): n is a, c, g, or t
  misc_feature (1531777)..(1531876): n is a, c, g, or t
  misc_feature (1533030)..(1533129): n is a, c, g, or t
  misc_feature (1534192)..(1534291): n is a, c, g, or t
  misc_feature (1534520)..(1534619): n is a, c, g, or t
  misc_feature (1535076)..(1535175): n is a, c, g, or t
  misc_feature (1535803)..(1535902): n is a, c, g, or t
  misc_feature (1536850)..(1536949): n is a, c, g, or t
  misc_feature (1539501)..(1539600): n is a, c, g, or t
  misc_feature (1542421)..(1542520): n is a, c, g, or t
  misc_feature (1544195)..(1544294): n is a, c, g, or t
  misc_feature (1544838)..(1544937): n is a, c, g, or t
  misc_feature (1549328)..(1549427): n is a, c, g, or t
  misc_feature (1551082)..(1551181): n is a, c, g, or t
  misc_feature (1566341)..(1566440): n is a, c, g, or t
  misc_feature (1567092)..(1567191): n is a, c, g, or t
  misc_feature (1568292)..(1568391): n is a, c, g, or t
  misc_feature (1569464)..(1569563): n is a, c, g, or t
  misc_feature (1570521)..(1570620): n is a, c, g, or t
  misc_feature (1571070)..(1571169): n is a, c, g, or t
  misc_feature (1571528)..(1571627): n is a, c, g, or t
  misc_feature (1571953)..(1572052): n is a, c, g, or t
  misc_feature (1573551)..(1573650): n is a, c, g, or t
  misc_feature (1573937)..(1574036): n is a, c, g, or t
  misc_feature (1575332)..(1575431): n is a, c, g, or t
  misc_feature (1576169)..(1576268): n is a, c, g, or t
  misc_feature (1577091)..(1577190): n is a, c, g, or t
  misc_feature (1581463)..(1581562): n is a, c, g, or t
  misc_feature (1583407)..(1583506): n is a, c, g, or t
  misc_feature (1584029)..(1584128): n is a, c, g, or t
  misc_feature (1584426)..(1584525): n is a, c, g, or t
  misc_feature (1588310)..(1588409): n is a, c, g, or t
  misc_feature (1591706)..(1591805): n is a, c, g, or t
  misc_feature (1592536)..(1592635): n is a, c, g, or t
  misc_feature (1597930)..(1598029): n is a, c, g, or t
  misc_feature (1598641)..(1598740): n is a, c, g, or t
  misc_feature (1599063)..(1599162): n is a, c, g, or t
  misc_feature (1602011)..(1602110): n is a, c, g, or t
  misc_feature (1602732)..(1602831): n is a, c, g, or t
  misc_feature (1603062)..(1603161): n is a, c, g, or t
  misc_feature (1605379)..(1605478): n is a, c, g, or t
  misc_feature (1606180)..(1606279): n is a, c, g, or t
  misc_feature (1610917)..(1611016): n is a, c, g, or t
  misc_feature (1612145)..(1612244): n is a, c, g, or t
  misc_feature (1613971)..(1614070): n is a, c, g, or t
  misc_feature (1615471)..(1615570): n is a, c, g, or t
  misc_feature (1621090)..(1621189): n is a, c, g, or t
  misc_feature (1621424)..(1621523): n is a, c, g, or t
  misc_feature (1625180)..(1625279): n is a, c, g, or t
  misc_feature (1632305)..(1632404): n is a, c, g, or t
  misc_feature (1632794)..(1632893): n is a, c, g, or t
  misc_feature (1633153)..(1633252): n is a, c, g, or t
  misc_feature (1635774)..(1635873): n is a, c, g, or t
  misc_feature (1637264)..(1637363): n is a, c, g, or t
  misc_feature (1645686)..(1645785): n is a, c, g, or t
  misc_feature (1646014)..(1646113): n is a, c, g, or t
  misc_feature (1646388)..(1646487): n is a, c, g, or t
  misc_feature (1648481)..(1648580): n is a, c, g, or t
  misc_feature (1649085)..(1649184): n is a, c, g, or t
  misc_feature (1650121)..(1650220): n is a, c, g, or t
  misc_feature (1651126)..(1651225): n is a, c, g, or t
  misc_feature (1652397)..(1652496): n is a, c, g, or t
  misc_feature (1655303)..(1655402): n is a, c, g, or t
  misc_feature (1657307)..(1657406): n is a, c, g, or t
  misc_feature (1672524)..(1672623): n is a, c, g, or t
  misc_feature (1672897)..(1672996): n is a, c, g, or t
  misc_feature (1673264)..(1673363): n is a, c, g, or t
  misc_feature (1673718)..(1673817): n is a, c, g, or t
  misc_feature (1675225)..(1675324): n is a, c, g, or t
  misc_feature (1679520)..(1679619): n is a, c, g, or t
  misc_feature (1680307)..(1680406): n is a, c, g, or t
  misc_feature (1683998)..(1684097): n is a, c, g, or t
  misc_feature (1687831)..(1687930): n is a, c, g, or t
  misc_feature (1690729)..(1690828): n is a, c, g, or t
  misc_feature (1691786)..(1691885): n is a, c, g, or t
  misc_feature (1693458)..(1693557): n is a, c, g, or t
  misc_feature (1694855)..(1694954): n is a, c, g, or t
  misc_feature (1695694)..(1695793): n is a, c, g, or t
  misc_feature (1700526)..(1700625): n is a, c, g, or t
  misc_feature (1701037)..(1701136): n is a, c, g, or t
  misc_feature (1704708)..(1704807): n is a, c, g, or t
  misc_feature (1708020)..(1708119): n is a, c, g, or t
  misc_feature (1709448)..(1709547): n is a, c, g, or t
  misc_feature (1709751)..(1709850): n is a, c, g, or t
  misc_feature (1710675)..(1710774): n is a, c, g, or t
  misc_feature (1711081)..(1711180): n is a, c, g, or t
  misc_feature (1711527)..(1711626): n is a, c, g, or t
  misc_feature (1711865)..(1711964): n is a, c, g, or t
  misc_feature (1713364)..(1713463): n is a, c, g, or t
  misc_feature (1718066)..(1718165): n is a, c, g, or t
  misc_feature (1719828)..(1719927): n is a, c, g, or t
  misc_feature (1721257)..(1721356): n is a, c, g, or t
  misc_feature (1722825)..(1722924): n is a, c, g, or t
  misc_feature (1725108)..(1725207): n is a, c, g, or t
  misc_feature (1729395)..(1729494): n is a, c, g, or t
  misc_feature (1729968)..(1730067): n is a, c, g, or t
  misc_feature (1730720)..(1730819): n is a, c, g, or t
  misc_feature (1731088)..(1731187): n is a, c, g, or t
  misc_feature (1734605)..(1734704): n is a, c, g, or t
  misc_feature (1735665)..(1735764): n is a, c, g, or t
  misc_feature (1736474)..(1736573): n is a, c, g, or t
  misc_feature (1739213)..(1739312): n is a, c, g, or t
  misc_feature (1739869)..(1739968): n is a, c, g, or t
  misc_feature (1741780)..(1741879): n is a, c, g, or t
  misc_feature (1742103)..(1742202): n is a, c, g, or t
  misc_feature (1744287)..(1744386): n is a, c, g, or t
  misc_feature (1751623)..(1751722): n is a, c, g, or t
  misc_feature (1752655)..(1752754): n is a, c, g, or t
  misc_feature (1754512)..(1754611): n is a, c, g, or t
  misc_feature (1754986)..(1755085): n is a, c, g, or t
  misc_feature (1759088)..(1759187): n is a, c, g, or t
  misc_feature (1759567)..(1759666): n is a, c, g, or t
  misc_feature (1759929)..(1760028): n is a, c, g, or t
  misc_feature (1760272)..(1760371): n is a, c, g, or t
  misc_feature (1760664)..(1760763): n is a, c, g, or t
  misc_feature (1765680)..(1765779): n is a, c, g, or t
  misc_feature (1767133)..(1767232): n is a, c, g, or t
  misc_feature (1768650)..(1768749): n is a, c, g, or t
  misc_feature (1769594)..(1769693): n is a, c, g, or t
  misc_feature (1770020)..(1770119): n is a, c, g, or t
  misc_feature (1770385)..(1770484): n is a, c, g, or t
  misc_feature (1772425)..(1772524): n is a, c, g, or t
  misc_feature (1773627)..(1773726): n is a, c, g, or t
  misc_feature (1780737)..(1780836): n is a, c, g, or t
  misc_feature (1786283)..(1786382): n is a, c, g, or t
  misc_feature (1787172)..(1787271): n is a, c, g, or t
  misc_feature (1787872)..(1787971): n is a, c, g, or t
  misc_feature (1788298)..(1788397): n is a, c, g, or t
  misc_feature (1788731)..(1788830): n is a, c, g, or t
  misc_feature (1789898)..(1789997): n is a, c, g, or t
  misc_feature (1790317)..(1790416): n is a, c, g, or t
  misc_feature (1791819)..(1791918): n is a, c, g, or t
  misc_feature (1793973)..(1794072): n is a, c, g, or t
  misc_feature (1794276)..(1794375): n is a, c, g, or t
  misc_feature (1796323)..(1796422): n is a, c, g, or t
  misc_feature (1799876)..(1799975): n is a, c, g, or t
  misc_feature (1804861)..(1804960): n is a, c, g, or t
  misc_feature (1805623)..(1805722): n is a, c, g, or t
  misc_feature (1805930)..(1806029): n is a, c, g, or t
  misc_feature (1816408)..(1816507): n is a, c, g, or t
  misc_feature (1817139)..(1817238): n is a, c, g, or t
  misc_feature (1824098)..(1824197): n is a, c, g, or t
  misc_feature (1828527)..(1828626): n is a, c, g, or t
  misc_feature (1829378)..(1829477): n is a, c, g, or t
  misc_feature (1830070)..(1830169): n is a, c, g, or t
  misc_feature (1830546)..(1830645): n is a, c, g, or t
  misc_feature (1831339)..(1831438): n is a, c, g, or t
  misc_feature (1832757)..(1832856): n is a, c, g, or t
  misc_feature (1842813)..(1842912): n is a, c, g, or t
  misc_feature (1843166)..(1843265): n is a, c, g, or t
  misc_feature (1846822)..(1846921): n is a, c, g, or t
  misc_feature (1848956)..(1849055): n is a, c, g, or t
  misc_feature (1850429)..(1850528): n is a, c, g, or t
  misc_feature (1854287)..(1854386): n is a, c, g, or t
  misc_feature (1854711)..(1854810): n is a, c, g, or t
  misc_feature (1855625)..(1855724): n is a, c, g, or t
  misc_feature (1862947)..(1863046): n is a, c, g, or t
  misc_feature (1863902)..(1864001): n is a, c, g, or t
  misc_feature (1864415)..(1864514): n is a, c, g, or t
  misc_feature (1864948)..(1865047): n is a, c, g, or t
  misc_feature (1870630)..(1870729): n is a, c, g, or t
  misc_feature (1872281)..(1872380): n is a, c, g, or t
  misc_feature (1875769)..(1875868): n is a, c, g, or t
  misc_feature (1877457)..(1877556): n is a, c, g, or t
  misc_feature (1880106)..(1880205): n is a, c, g, or t
  misc_feature (1880572)..(1880671): n is a, c, g, or t
  misc_feature (1884817)..(1884916): n is a, c, g, or t
  misc_feature (1885320)..(1885419): n is a, c, g, or t
  misc_feature (1885653)..(1885752): n is a, c, g, or t
  misc_feature (1889352)..(1889451): n is a, c, g, or t
  misc_feature (1889902)..(1890001): n is a, c, g, or t
  misc_feature (1892433)..(1892532): n is a, c, g, or t
  misc_feature (1898775)..(1898874): n is a, c, g, or t
  misc_feature (1899313)..(1899412): n is a, c, g, or t
  misc_feature (1901566)..(1901665): n is a, c, g, or t
  misc_feature (1906754)..(1906853): n is a, c, g, or t
  misc_feature (1912267)..(1912366): n is a, c, g, or t
  misc_feature (1914904)..(1915003): n is a, c, g, or t
  misc_feature (1920004)..(1920103): n is a, c, g, or t
  misc_feature (1923639)..(1923738): n is a, c, g, or t
  misc_feature (1924388)..(1924487): n is a, c, g, or t
  misc_feature (1936615)..(1936714): n is a, c, g, or t
  misc_feature (1938939)..(1939038): n is a, c, g, or t
  misc_feature (1939634)..(1939733): n is a, c, g, or t
  misc_feature (1940198)..(1940297): n is a, c, g, or t
  misc_feature (1944216)..(1944315): n is a, c, g, or t
  misc_feature (1946788)..(1946887): n is a, c, g, or t
  misc_feature (1955221)..(1955320): n is a, c, g, or t
  misc_feature (1957957)..(1958056): n is a, c, g, or t
  misc_feature (1960050)..(1960149): n is a, c, g, or t
  misc_feature (1963832)..(1963931): n is a, c, g, or t
  misc_feature (1964694)..(1964793): n is a, c, g, or t
  misc_feature (1965334)..(1965433): n is a, c, g, or t
  misc_feature (1965800)..(1965899): n is a, c, g, or t
  misc_feature (1966285)..(1966384): n is a, c, g, or t
  misc_feature (1967071)..(1967170): n is a, c, g, or t
  misc_feature (1971224)..(1971323): n is a, c, g, or t
  misc_feature (1975423)..(1975522): n is a, c, g, or t
  misc_feature (1976805)..(1976904): n is a, c, g, or t
  misc_feature (1977424)..(1977523): n is a, c, g, or t
  misc_feature (1982866)..(1982965): n is a, c, g, or t
  misc_feature (1983344)..(1983443): n is a, c, g, or t
  misc_feature (1990967)..(1991066): n is a, c, g, or t
  misc_feature (1994562)..(1994661): n is a, c, g, or t
  misc_feature (1998754)..(1998853): n is a, c, g, or t
  misc_feature (2001787)..(2001886): n is a, c, g, or t
  misc_feature (2003972)..(2004071): n is a, c, g, or t
  misc_feature (2006806)..(2006905): n is a, c, g, or t
  misc_feature (2011756)..(2011855): n is a, c, g, or t
  misc_feature (2012101)..(2012200): n is a, c, g, or t
  misc_feature (2013371)..(2013470): n is a, c, g, or t
  misc_feature (2014370)..(2014469): n is a, c, g, or t
  misc_feature (2014994)..(2015093): n is a, c, g, or t
  misc_feature (2015444)..(2015543): n is a, c, g, or t
  misc_feature (2018074)..(2018173): n is a, c, g, or t
  misc_feature (2018531)..(2018630): n is a, c, g, or t
  misc_feature (2018854)..(2018953): n is a, c, g, or t
  misc_feature (2019971)..(2020070): n is a, c, g, or t
  misc_feature (2020284)..(2020383): n is a, c, g, or t
  misc_feature (2021581)..(2021680): n is a, c, g, or t
  misc_feature (2026083)..(2026182): n is a, c, g, or t
  misc_feature (2027454)..(2027553): n is a, c, g, or t
  misc_feature (2027821)..(2027920): n is a, c, g, or t
  misc_feature (2028309)..(2028408): n is a, c, g, or t
  misc_feature (2029336)..(2029435): n is a, c, g, or t
  misc_feature (2030397)..(2030496): n is a, c, g, or t
  misc_feature (2031018)..(2031117): n is a, c, g, or t
  misc_feature (2033866)..(2033965): n is a, c, g, or t
  misc_feature (2034181)..(2034280): n is a, c, g, or t
  misc_feature (2034623)..(2034722): n is a, c, g, or t
  misc_feature (2035886)..(2035985): n is a, c, g, or t
  misc_feature (2039284)..(2039383): n is a, c, g, or t
  misc_feature (2040310)..(2040409): n is a, c, g, or t
  misc_feature (2040879)..(2040978): n is a, c, g, or t
  misc_feature (2042149)..(2042248): n is a, c, g, or t
  misc_feature (2043332)..(2043431): n is a, c, g, or t
  misc_feature (2045320)..(2045419): n is a, c, g, or t
  misc_feature (2046277)..(2046376): n is a, c, g, or t
  misc_feature (2046671)..(2046770): n is a, c, g, or t
  misc_feature (2046977)..(2047076): n is a, c, g, or t
  misc_feature (2048090)..(2048189): n is a, c, g, or t
  misc_feature (2048464)..(2048563): n is a, c, g, or t
  misc_feature (2048997)..(2049096): n is a, c, g, or t
  misc_feature (2053604)..(2053703): n is a, c, g, or t
  misc_feature (2054097)..(2054196): n is a, c, g, or t
  misc_feature (2054466)..(2054565): n is a, c, g, or t
  misc_feature (2056021)..(2056120): n is a, c, g, or t
  misc_feature (2056391)..(2056490): n is a, c, g, or t
  misc_feature (2056915)..(2057014): n is a, c, g, or t
  misc_feature (2058190)..(2058289): n is a, c, g, or t
  misc_feature (2058815)..(2058914): n is a, c, g, or t
  misc_feature (2059481)..(2059580): n is a, c, g, or t
  misc_feature (2060796)..(2060895): n is a, c, g, or t
  misc_feature (2063964)..(2064063): n is a, c, g, or t
  misc_feature (2068412)..(2068511): n is a, c, g, or t
  misc_feature (2069037)..(2069136): n is a, c, g, or t
  misc_feature (2070344)..(2070443): n is a, c, g, or t
  misc_feature (2070675)..(2070774): n is a, c, g, or t
  misc_feature (2082201)..(2082300): n is a, c, g, or t
  misc_feature (2084468)..(2084567): n is a, c, g, or t
  misc_feature (2085647)..(2085746): n is a, c, g, or t
  misc_feature (2086759)..(2086858): n is a, c, g, or t
  misc_feature (2087559)..(2087658): n is a, c, g, or t
  misc_feature (2088492)..(2088591): n is a, c, g, or t
  misc_feature (2089779)..(2089878): n is a, c, g, or t
  misc_feature (2090124)..(2090223): n is a, c, g, or t
  misc_feature (2090579)..(2090678): n is a, c, g, or t
  misc_feature (2092133)..(2092232): n is a, c, g, or t
  misc_feature (2098179)..(2098278): n is a, c, g, or t
  misc_feature (2099716)..(2099815): n is a, c, g, or t
  misc_feature (2101053)..(2101152): n is a, c, g, or t
  misc_feature (2101497)..(2101596): n is a, c, g, or t
  misc_feature (2101830)..(2101929): n is a, c, g, or t
  misc_feature (2102455)..(2102554): n is a, c, g, or t
  misc_feature (2102811)..(2102910): n is a, c, g, or t
  misc_feature (2103205)..(2103304): n is a, c, g, or t
  misc_feature (2103624)..(2103723): n is a, c, g, or t
  misc_feature (2104926)..(2105025): n is a, c, g, or t
  misc_feature (2105268)..(2105367): n is a, c, g, or t
  misc_feature (2106738)..(2106837): n is a, c, g, or t
  misc_feature (2107153)..(2107252): n is a, c, g, or t
  misc_feature (2114801)..(2114900): n is a, c, g, or t
  misc_feature (2115282)..(2115381): n is a, c, g, or t
  misc_feature (2115935)..(2116034): n is a, c, g, or t
  misc_feature (2116332)..(2116431): n is a, c, g, or t
  misc_feature (2116706)..(2116805): n is a, c, g, or t
  misc_feature (2117028)..(2117127): n is a, c, g, or t
  misc_feature (2117668)..(2117767): n is a, c, g, or t
  misc_feature (2118525)..(2118624): n is a, c, g, or t
  misc_feature (2122172)..(2122271): n is a, c, g, or t
  misc_feature (2125126)..(2125225): n is a, c, g, or t
  misc_feature (2125473)..(2125572): n is a, c, g, or t
  misc_feature (2126359)..(2126458): n is a, c, g, or t
  misc_feature (2139673)..(2139772): n is a, c, g, or t
  misc_feature (2142280)..(2142379): n is a, c, g, or t
  misc_feature (2145886)..(2145985): n is a, c, g, or t
  misc_feature (2146338)..(2146437): n is a, c, g, or t
  misc_feature (2147870)..(2147969): n is a, c, g, or t
  misc_feature (2149169)..(2149268): n is a, c, g, or t
  misc_feature (2149619)..(2149718): n is a, c, g, or t
  misc_feature (2153056)..(2153155): n is a, c, g, or t
  misc_feature (2155133)..(2155232): n is a, c, g, or t
  misc_feature (2155440)..(2155539): n is a, c, g, or t
  misc_feature (2155952)..(2156051): n is a, c, g, or t
  misc_feature (2156305)..(2156404): n is a, c, g, or t
  misc_feature (2157045)..(2157144): n is a, c, g, or t
  misc_feature (2157726)..(2157825): n is a, c, g, or t
  misc_feature (2158368)..(2158467): n is a, c, g, or t
  misc_feature (2159378)..(2159477): n is a, c, g, or t
  misc_feature (2163662)..(2163761): n is a, c, g, or t
  misc_feature (2166509)..(2166608): n is a, c, g, or t
  misc_feature (2167326)..(2167425): n is a, c, g, or t
  misc_feature (2167784)..(2167883): n is a, c, g, or t
  misc_feature (2169312)..(2169411): n is a, c, g, or t
  misc_feature (2169662)..(2169761): n is a, c, g, or t
  misc_feature (2170727)..(2170826): n is a, c, g, or t
  misc_feature (2174269)..(2174368): n is a, c, g, or t
  misc_feature (2175462)..(2175561): n is a, c, g, or t
  misc_feature (2179344)..(2179443): n is a, c, g, or t
  misc_feature (2179689)..(2179788): n is a, c, g, or t
  misc_feature (2180463)..(2180562): n is a, c, g, or t
  misc_feature (2181508)..(2181607): n is a, c, g, or t
  misc_feature (2182014)..(2182113): n is a, c, g, or t
  misc_feature (2183021)..(2183120): n is a, c, g, or t
  misc_feature (2184135)..(2184234): n is a, c, g, or t
  misc_feature (2184467)..(2184566): n is a, c, g, or t
  misc_feature (2184850)..(2184949): n is a, c, g, or t
  misc_feature (2192010)..(2192109): n is a, c, g, or t
  misc_feature (2193532)..(2193631): n is a, c, g, or t
  misc_feature (2193857)..(2193956): n is a, c, g, or t
  misc_feature (2205486)..(2205585): n is a, c, g, or t
  misc_feature (2206557)..(2206656): n is a, c, g, or t
  misc_feature (2208814)..(2208913): n is a, c, g, or t
  misc_feature (2210305)..(2210404): n is a, c, g, or t
  misc_feature (2210637)..(2210736): n is a, c, g, or t
  misc_feature (2211094)..(2211193): n is a, c, g, or t
gagtatgcgattcttcctgaattagctttccgtgttgaatatcaatggttgagcaatgtaggtaacttcactaaagctgaagcgaaagagaatcgtagagcaacttacaactatagcccagattctcattctgtgaccgcaggtatttcatatcgctttggtcaaggtgcagcaccagttgcagcagcaccagaagttgtaactaaaaacttcgcgttcagctcagacgtattatttgacttcggtaaagcaaacttaaaaccagctgcagcacaaacattagacgcagtacacactgagatcgtaaatttaggtttagcaaaccctgctgtacaagtaaacggttacacagaccgtattggtaaagatgctgccaacttaactctttcacaaaaacgtgcagaaacagtagcaaactacatcgtttctaaaggtgttaacccagctaacgtaacagcggtaggttacggtgaagctaacccagtaactggtaacacatgtgacgcagttaaaggtcgtaaagcattaatcacttgcttagcaccagatcgccgtgttgaaatccaagttcaaggttcaaaagaagtttctatgtaatcacttttgaatccaagaaacttaaaaaatgcccgcaaaagcgggcatttttattataccgagaaacttttattctttattttacccatctatttcttcaccggtttgatcccacttaaagtttaatgcaatagaatttaagcagaagcgtaatcctgtaggttgaggcccatctttaaaaacgtgtcccatatgggcatcacaattgccacagcgaatctcaacacgatgtctgcctaaactataatcatctacataacgtaatgaagactccgagatcgtttcataaaaacttggccagccacaaccagcatcaaatttggcatcagaacgaaataacgcattatggcaacgaacacagcgatatgtccccaccctattttcttttaggaacttaccactgaaaggtttttctgtacctgcatttaaacaaatttcaatctgttcttcggttaattcactaatatctttaatcattttaaatccttttctcttattggtttgttaccaattattctaactttttttagttaaaagcaagagagggttttaaaaaatttgacatagatcacataaaatttatctgctatattttgctctgttctttagttgtcagaaaagggaaagattgtgttataatcctctcgcttttccaatgtctaggaaagaacaaattttgtttaactttaatataggtagaaaatctatggcaattaaaattggtattaacggctttggccgtatcggtcgtatcgtattccgtgcagcacaaaaacgtgatgacatcgaagtagttggtatcaacgacttaattgatgttgagtatatggcatatatgctcaaatacgattcaactcacggtcgtttcgatggcactgtcgaagtaaaagacggcaaattagttgtaaacggtaaagaaatccgtgttacttctgagcgtgacccagctaacttaaaatggaatgaaattggtgtggatatcgcagttgaagcaacaggtttattcttggacgatacaactgctcgtaaacacatcgaagctggtgcgaaaaaagtcgttttaactggtccatctaaagataacacacctatgttcgtaaacggtgtaaacttcaacgcttatgctggtcaagacatcgtttctaacgcttcttgtacaacaaactgcttagcaccacttgctcgtgttatccacgaaacatttggtatcaaagaaggtttaatgacaactgttcatgcaacaacagcaacacaaaaaactgttgatggtccatcagcaaaagactggcgcggtggtcgtggtgcggcacaaaacatcattccatcttcaacaggtgcagcgaaagcagtaggtaaagtattaccagcattaaacggtaaattaacaggtatggcgttccgtgttccaacagcaaacgtatctgttgttgatttaactgtaaacttagaaaaaccagcaagctacgaagagatcaaaaaagcgatcaaagatgcagcagaaggtaaaacattcaacggcgaattaaaaggcgttttaggttatactgaagatgcagtagtatcaacagacttcaacggtgcagttgaaacttctgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcattaacagatacattcgtgaaacttgtttcttggtatgacaacgaaactggttactcaaacaaagtattagacttagttgctcacatttacaactacaaaggctaattaaaatagtaatattggaaatggcaatatataaatctatattgccattttttatatagaaataagcctatatgaagtagtatataataaattaccaattcactgaattatttatagcctcacgttgttctgaatgagatagtcttagatataaagcagtcatatttacatttgaatgccctaacagatcggctaataaagcaatattattatttttctttaaaaattgtatagcaaagaaatgcctaaaattatgagggtggacaacatcttttctgatgccacacttttctgcgtatattttcaaattatgagcaatacctctagctgaaataggtgctccatatctattcaggaataattcttttttatgattttgaaaaattcacgagattcattaatcaggctttgaggaatattaattcttctaaattttcctttagaatggcattcagcatatcctttttctaaatcttgtattgtgaattttactagttcacttattctagctccagtgcttcctaagaaccttacaataaagtaataacgtaaattatattcctttaaataatcgcatagagttttgtattctggaaatgacatgattccttctgtaaaatgatacttaggtaatggaatatgctttaatttaaatggttttatattcttatgattgaaaatactttgataaaaaattgatattaaatattatatcttatatttattgatcctcctattaaaaataattctaaatttatcactattaaaagtaagttcgtaatatattttatatgtttttttatcttaaaaataattaacttttgtattgaagttgattatttaaaatgttataattaaccttctttctatagaaggttttcacttaataattgaatagcttatagaaataattaggtatgtttacaacgcaattaggaaattttaatgagtgaattggctaaagatattattcctatcagtattgaagaggaactaaaaaattcctatcttgattatgcaatgtctgtgattgttgggcgagcgttaccagatgtgcgagatggtttgaagcccgttcatcgacgcgtacttttttctatggatcaaagcggtaacgtatcatctaaaccttatgtgaaatcggcacgtgtagtcggtgatgtgatcggtaaatatcaccctcacggtgattctgcggtgtatgatacgattgtgcgtatggctcagccgttctctcttcgttatatgttggtagatggtcaagggaactttggttcgattgacggggatgcgcctgcggcaatgcgttataccgaagtgcgtatgcagaagattacacaagaattgttaacggatttggataaagaaacagtggatttctcgccaaattatgatggtaaagagatgatccctgatgtattaccgactaaaattccggcattgcttgttaatggttcttcgggaatcgccgtgggtatggcaaccaatattcctcctcataacctaaatgaagtgttaaacggttgcttagcttatattgaaaacgaacaaattacgattgaagagttgatgcaacatattcccggtcctgatttcccaacggcggcgattattaatggtcgtaaagggattgaagatgcttatcgtacaggtcgtggcaaagtgtatgtacgagccaaagccagtgttgaaacaacttcaaaaggccgtgagcagattgtcgtcacggaattgccgtatcaagttaataaaaagaatttaatcgaaaaaattgccgaattggtgcgtgataagcgtattgaaggtatttcaagtattgaagactattctgataaaaaagggatttcgattgttattgaaatcaaaaataatgctgttggtgaagtggtactcaataatttgtacgctctcacacaaatgcaagtgactttcggtatcaatatggtggcactcgatcatggtcagccaaaaattttcaatctcaaacagattattgaagctttcgtgatgcaccgtcgtgaagttgtaacacgccgtacggtctttgaattgcgtaaagcacgtgaacgtgcacatattttagaaggtctagcgattgcattagccaatatagatcctgtgattgagctgattcgaaattccaaaactgccgatgaagcacgtgaaggtttattggatcgtccgtggtcgttaggtaatgttgcaccaatgcttgaagcagcgggtgtagatgcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctcagagcgtttaatggaagtcatccgtgaagagcttgaaaaaatcaaagccgaatttggcgatgagcgtcgcactgaaattactgcggcttcaggcgatattaatttagaagatttaattgctcaagaagatgtagttgtgaccttatcgcacgctggttatgtgaaatatcagccgttatcggattacgaagcacaacgtcgtggtggtaaaggtaaatcagcaacgaaaatgaaagaggatgatttcattgaaaaattattggtcgctaatactcatgataccattctctgcttctcaagctgtggtcgtttatatcaattaaaagtctatcaattaccacaggcaagccgtggtgcaagaggtacgccaatcgtaaatattcttccacttgtaaaagaggagaatgagcgtatcactgcaattcttcccgttccaaatggtgaatttagcgctgataaatttatttttatggcaacggcgagtggtacggtgaaaaaagtttcgctcgatgcatttagtaatgttagatcaagcggtctaattgcattaaaacttcgcgagggtgatgaattaatcggggtagatattaccaatggcgagagtgaaatcatgttgttctcggcgcaaggtcgagtggtacgctttgcagaaactgcagtgcggggaatggggcgtgttgcaacaggggttcgaggtattaaattagcaacaaccgaaatttcagtcgatgatgctgaagaagtcgatattgaaactgttgaaaacgaagaagctgaagaagcctcaagtgttaacttaaccaccgataaagtggtttcccttgtaattccacatactcaaggtgaaatcttaaccgttacccaaaacggttatggtaaacgtactgccttaggtgagtatccggtcaaatctcgtgcaacaaaaggggtggtttcaattaaagtgaatgaacgtaacggtaaagtggttgcagcagttcaggttgaagaaaatgaccaaattatgttgattaccgatgccggtacattagtacgtacccgtgtaaacgaagtcagccttgtaggacgtaatacccaaggtgttcgtattattcgtaccgcagaagacgaacatgttgtcagccttgaacgaatctgtgaaattgaagacgacggtatagaaaatttatctgttgaagaagcataatttattaaggctgtgattcacagccttaatattttgtaagataatgccttatttttattgggattgtcctaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcattggtatatcctcttccattttagaacgctatcaattatacaacatcattatgtagatgaaatgctaaaaatcaaacgaaaatctgagaataaagtgaaagatatttccgtattaaatgctcaaatatccttaaaaatcacctacttaatgagatcaattatcactacatagcattctgaaaattatttttttgagatagatcacaaaactatttttttatgttacaaaattgtaaaaattcattataaaatatccaaattaatggcaaaatgcttccatattaggtttatatactttactttcccaaggaggaaatcgtgcaaactgtcaatgtagatgttgcaattgtgggtgcaggtggcggtggtttaagagccgcaatcgcagcagcagaagctaacccgaatttgaaaattgcattaatttcaaaagtttatcctatgcgtagccatacggttgctgcagaaggtggggcggcggcagtcgctaaagaggaagactcttacgataaacacttccacgatactgtggcaggtggcgactggctttgtgaacaagatgttgttgaatatttcgtagaacactcgccagttgaaatgacccaattagagcgttggggctgtccgtggagccgtaaagctgatggtgatgtgaacgttcgccgtttcggtggtatgaaaattgaacgtacttggttcgcagccgataaaacaggtttccacctattacacaccctattccaaacctcaattaaatatccacaaattatccgttttgatgagcattttgtcgtggatattctcgttgatgatggtcaagtgcgtggctgtgttgcaatgaatatgatggaaggaactttcgttcaaatcaatgcaaatgcggtagttatcgcaacaggtggcggttgccgtgcttatcgtttcaacaccaacggcggtatcgtaacgggtgacggtttatcaatggcgtatcgccacggcgtgccacttcgtgatatggaatttgtacaatatcacccaacaggcttaccaaacacaggtatcttaatgaccgaaggttgtcgtggtgaaggcggtatcttagtcaataaagatggctaccgttacttacaagattatggtctaggcccagaaactccagttggcaaaccagaaaataaatatatggaattaggccctcgtgataaagtttcccaagcattctggcaagagtggcgtaaaggtaacaccttaaaaactgccaaaggtgttgatgtggttcaccttgacctacgtcacttaggtgaaaaatatttacacgaacgtctgccatttatctgtgaattagcacaagcctacgaaggcgtagatccagcgaaagcaccaattccagttcgtccagttgttcactatacaatgggtggtattgaagttgatcagcacgcagaaacctgtatcaaaggcttatttgcagtgggcgaatgtgcatcttctggtttacacggtgcaaaccgcttaggttctaactcattagcagaacttgtggtattcggtaaagttgcaggtgaaatggctgcaaaacgtgctgttgaagcgaccgctcgtaatcaagccgtaattgacgctcaagcaaaagatgtcttagaacgtgtttatgccttagcccgtcaagagggtgaagagtcttggtcacaaatccgtaacgaaatgggcgactcaatggaagaaggctgtggtatctaccgtactcaagaaagtatggaaaaaaccgtagcgaaaattgcagagttaaaagagcgttacaaacgtatcaaagtgaaagacagctcaagtgtatttaatacagacttgctctacaaaattgaacttggttatatccttgacgtagcacaatctatctcatcttctgcggtagaacgtaaagagtctcgtggtgcacaccaacgtttagactacgttgaacgtgatgatgtgaactacttaaaacacacccttgcattctacaatgcagacggcgcaccaacaatcaaatacagcgacgtgaaaattaccacatcacaaccagctaaacgtgtttatggtgcagaagcagaagctcaagaaaaagcagcgaaaaaggagtaacagaagatgactaaccaaagtaaaatgacggtagaagtacttcgttataaccctgaacaagataacgaaccgtacttatcaaaatatgaagtaccttatgatagccaaacttcgttacttgatgcacttggctacatcaaagatgaattagagccagagctttcataccgttggtcttgccgtatggcgatctgtggctcttgcggtatgatggtaaacggcaaaccaaagcttgcatgtaaaacattcttacgcgattacaggggttatatgcgaattgaaccgcttgcaaacttcccgattgaacgtgacttagttgttgatttaagccacttcatcgaaagtttagaaagcatcaagccatacattattgacaacaaagcgcctgaacttgatggcaaaccacacccatcagcagagcttgcgaaaagccgtaccaaacaaaccccagcacaacttgagaaataccgtaccttctcaatgtgtattaactgcggtttatgctatgccgcttgcccacaatttggcttaaaccctgaatttgtaggcccagcagcattaaccttagctcaccgttacaaccttgataaccgtgacaatggtaaagcggaacgtatgaaaattatcaacggtaaaaacggtgtatggagctgtacattcgtcggctactgctctgaagtttgtccgaagcatgttggtccagcctctgcggtaaaccaaggtaagatcgaaagtgccaaagattatgtctttgcaatgttaaaaccgcaaaagtaaggagagagtaaaatgacaacaacagcaagtaaacgcaaaaaatatgtgcgtgaagtgaaaccaacttggtggaaagcgttagatttttacaaattctacgttttgcgtgaaagtacctctgttcctaccatttggttctgtttagtgcttttctacggcttagcatgcttaggaaaagagaacggatttgtagagaatttcattccattcttacaaaatccattagtggtagttttaaatattattacccttggtgcagtattattaaatagctttaccttctttggtatggcacctcaaatgatgaacgttatcgtgaaaaatgaacgtattgacgttaaactcgtttctcgcgtattttggggtattactgctttcgtaagccttttagctttaatcttggtatagggagagcataaaaatggataaacttaatcctccacgttcaaatgaacctgcagtatggctacttttcggtgctggcggtgctattagtgcaatcttcttccctgtgcttgtattaatcttaggtttcttactgccatttggactaattacaccagataacatcattgcattcgcacacacttggatcggtaaactcgctattctagcattactaatattcccaatgtggtgtggtatgcaccgtatccacctaggcttgcacgattttaaagtacacgttcctgcaggcggttggattttctatggtttatctgcactttatagtgtattagtgatttttgcggtgattaatttataagttaaagtcttgttgaacagctattccctgtaagaaatagctatttatagtagacatttttcttgtcttctttgagataagctcatataattaggacatctacagtataaatgtagatgtctttctatgaggaaactttgggcttctcgcagtagtctttaatttacttggtcaggttcggaagaaagcagccagaattagaatagctaagtgccgagtctatgcttaaagtttcctctcccttaactagtcttttgggagaagaaaacatacgcactgctttataagattagttcctctgttaatgtcagctttccgttaatcatgcagagctcttttgtactcattaacccacattgctgtagcaccacacacggcaacaggcattaccactaagttaataaatggcaacatcgtaaaaatactcaccaaagccccaaaagtaaaattcattgtacgatattgtgctaatgcatttcgcatacgttgaaattgaattttatgattatcaaaagggtagtcacaatattgaattgcaattaaccaagccccgaaaataaatgtcaaaatagggataatagtctgccctaaaacagggataaaacctaataaaaataaggcaatcaaacgtggaatgctataccacattttttgccactcacgtttgagcatacgaggtacatcttttagcatttcattaaaactcatttccgtgagattttcaccagtgagttgttgctcaactttttctgcgagtaacgcattaaatggggcagcaataaaattcgctaaagtggtgaaagcaaagtagaaagcaactaaaatcattaaaaaagccaatggaataaggataaaactcaaccattctaaccacgaaggcaagagcgaatctaacattccccctacattggcaaaaaagagccaaattaggctaatcatcaacactgcattgataattacaggaaaaataataaatggcattaactgacgctgtaacattaatcgccaaccatagatgaaatagtgaaagccagcaccaatttgtgtttctggggtagaaaatagcgaagacataattaacctttctattcaaatttttagaagaaatatggtaagctatgcacacattttcacaaagtgttaaatttcaattttgatgattttatgagctaaagagggcaaaatggaaactcatattcttttctttattttagcaggattattaatcgctgttttaattggatacagtatttggtctgcacgcagagaaaaatctcgtattttttcaaataccttttccactcgtccgccttcatctccaattaacaatgaaattacagcagatattccaacaacgctaaatcctcaaggtgtcgtagctcagcaaccattcaatactgaaacacctgctgattttattcaatctcagcaagaagttgagaatagtgtcaaaaatattcgtattagtttacaaactcaagaaatatctcaacctttatatcaagagtctatgccagaatctcaatctgaagcatatcaacaaaatcagatacaagaacagactgtccaagtagagcaagttgaaacaatagaacaaactacggagcataatataatcactttgtatgttgttgcaccagaaggcgttcaatttcaaggtaatgccattgtacaaaatttagaaatgttaggttttcattttggtgaataccagatcttccaccgccatttagataatcctgcaagtcctgtattgttcagcgtggcgaatatgatgcaaccaggagtctttgatttagcaagaatggaacagttttctacagtgggattagtattctttatgcacttaccttcagtaggtaatgatctagctaatttaaaattaatgattcgtaccgtagagagctttgctcaatctgttggcggttttgtcttagatgaacaacatcaaatttttaacgaggaatctcgccaaaattatctactacgagtagccaattaatttgcagtacattgtttaaatatgaccgcttgtaagcggtcttttttatcgagaaatttacagatgccacactctattgaaacccaacttgaacatttgcgtgaaaaattgcgtgaatatgaataccactaccacgttttagataatccgcttgtgcccgatgcagaatatgatcgcttgatgaacgagttaaaaaatctggaatggcaacaccccgaattgattacgtccgattcaccgacgcaacgagtcggtgctaagccgttagatggatttgctcaaattacccacgaaaccccaatgctttctctggataacgccttttcagatgatgacctcacaggctttttgcgtcgtattgaagatcgtattgcgatcaacagtaatcaaattgaattttgttgtgagccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttagcggtgagtattctgtatgttgacggagtgctaacccaagcggcaactcgtggcgacggaacaacaggggaagatattaccgccaatatccgcacgatccgtaatattccgttaaaactaaaaagtagtaatccgccacatcgtttagaagtgcgtggtgaagtttttatgccacagcagggctttgaacaattaaatgaaaaagcactggcaaaaggtgagaagacctttgctaacccgcgtaatgcagcggcaggttcacttcgtcagctcgatccgaaaatcactagacaacgtccgttaatgttgaatgcctataacattggggtttatgaaagtgatgatgaactccctacgacacattttgaccgcttgcagtggttaaaaaccctggggattcctgtcaatgctgaaattaccttagcaacaggttctcaagccttgactgcgttttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaatccaagccaaacgtagttcgctgggttacgacattgatggcacggtgttgaaagtcaatgagattacattgcaagaacagcttggctttatctcaaaagcacctcgttgggcaattgcttacaaattccctgcacaagaagagatgacgattctgaacgatgttgaatttcaggtcggcagaacaggggccattaccccagtggcaaaattagaacctgtctttgtggctggggtaacggtgagcaatgccaccttacataacggtgatgagattgagcgtttagggatcgcaattggtgataccgtgattattcgccgagcaggtgatgttattccgcaaattgtgggcgttgtggctgaacgtcgttttgacaatgcaaaaaaaattgcttttccgaccgcttgtcctgtgtgtaactcagctgtggtgcgtgtcgagggcgaagcggttgctcgttgtactgggggattattctgcggagcccaacgtaaagaggcgttaaagcatttcgtttcacgcaaagcaatggatattgatggcgtgggtgaaaaactgattgaacaactgatggaacgtgagctgatccgtaccccagcagatctatttaaactcgatcacaccatcttgatgcgtttagagcgaatgggggagaaatctgccaataacgcactacaaagtatcgaaaaggcaaaaaataccacccttgcccgcttcttatttgctttgggtattcgagatgtcggcgaatctaccgcacaaaatctcgcaaatcactttggtacgcttgatgcgattcgccaagcggatttagacacgctaaaacaggtacaagatgtaggggaagttgtggcaaaccgtctattccaattctggcaagaaccacataatattgaagtcgtggaagatctgattgctcaaggggtgaagtggcaagatgtggtgccacaagagattgcagacaatccattaaaagataaaacagtggtactaacagggacattaacacagctcacccgtgatcaagcaaaagccttattacagcaattgggttgtaaagtatctggcagtgtatcaagtaaaacggattatttgattgcaggggaaaaggctggttcaaaattggcaaaagcacaggaattgggagtgaaaattttgagtgaggacgagttaattggatattttacgactatagtatcgtaatatgtgaagcaagagtttgattttaactttagggctaatctaatacagcccctaaagttaatcacaagcaatactttctatatgatataaatgctctctaataagccctaaaaacgcctctccaaacctctccagttttctctcacctaccccattaatggaaagcatttcatctgccgtcgttggcataaattctgccatttcttgtagggtagcgtcattgaaaaccacataaggagggatattttccttatcggcaatctgtttgcgtaaaaagcgtaaacgggcaaaaagatctttatcataccgcttgctagcttgctgtttctgcacataagttgtcgccgaaaaacttaaacgtggggaagccagtgccaaggctgtttcaccgcgtaaaatggggcgagcttgttctgtgagttgtagggcagaatgattaacaatgttttggcgaataaagccaagatgaatgagctggcgagttacgctaatccaatattcttgcgatttatccttgccaatcccatagacagatagagtgtcgtgttgatattcacggattttttgctgatttaagccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggattttttgctgatttaagccccgaagaactgcaataatatgatgtaagccgaagcgttgtcctgtgcggtaaataacggacatcactttttgggcatcaactaagccatcatactttttcggtggatcaaggcaaatgtcacaattttgacaagcaacttggcgtgtttcaccaaaatagttgagtaacacaaggcgacggcaagtttgtgattcggcaaaagccccaatggcttgcaatttatgttgctcaatttgacgttgttcactttctggtttttctagtaataccttgtgtagccaaccataatccgaaggatcgtaaaataacaccgcttccgcaggaagatcatctctccctgctcgtcctgtttcttgataataggcttcaatgcttcttggcagatcaaaatgcacaacaaaacgcacattggatttgttgatccccattccaaaggcaacagtagcaacgacaatttgaatattatctcgttgaaacgcattttgaacggtttcccgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgcaccgtcattcctgcgtgatagcccattacagaaaaacgacgagcggaaagtttttccgtgagttcttcaactttcttacggctattgcaataaacaatcccacttttcccttgctgactgctgataaatttgattaattgatccacgggtttaaatttttcttgcaccgtatagcgaatgttaggacgatcaaaacttcctaaataagtatggggatcttctaacttaagatgatgaataatatcaaagcgagttgttggatcggcagtcgcagtcagcgcaacaagcggtatgtttgggaaagtttttcgcaaaccgcctaacaaggtgtattcagggcgaaaatcgtgtccccattgagatacgcaatgggcttcatcgactgcaatcaggctaattttgcacaatgagataaattggaaaaaattggatgtcattaccttttcgggtgaaaggtaaagtagcttgagttgtcctgaaatcgctttttgttcaaccgcttgctgttcttcaatagtttgagtggaattaatatagccagcttcaacaccattgataagcagttgatctacctgatctttcattagcgaaatcaaaggtgagatcacgagagttatgccttcaaaacagagggctggcacttgataacaaagggattttcctccccctgttgtcataatcaccaagcaatctttacccgacaagatcgcttcaatcacttctgattgaccttgtcggaaagattggtagccgaaaacgttatgtaaaaccgtttcagctttggcaagcggtgtaactgacattagctaaaagagatcgtttcgccgtgacgagcgacagcctcttctaaatgtgtccaaaatgaacgcccttccgcactgacccaatcgccatcacggtaagcaaagtgataaccacctaatttgcttgccagccagagttcaagcattgcttcttgcttgttaatgacaatttgtgaatcatcatcaaaagtaatggtaaaaaccgccccttgtgtttcacaatcgacatcgcaaccttgttcttcaagttgctcttcaatttgttcccacacttgttcaatcgcttgatgaaattctgctaaattcataaataatctcttcgtaaagccaaaatttgaaaggcgttattttggatttttctgaacactttttcaatagaaatctgaaaggttacatccacgcattactacgaataacgcccacggcaatgccttcgatttcaatataagattgacgaggatcgacgacaatcggctctaattcatcattttctgggtgtaaatagattaaatcgccttttttctctaagcgtttgacggtgacttcatcatcaacacgagcgacaaccacctgtccattacgaacagatttagttttatgcactgcgagtaaatcaccatctaagataccaattttttccattgagttcccattcaccttaagaagataatcggcagctggcgagaacattgccccattcacaggataatgtttttcgatatgttcaatggcttcaatcggcgtacctgctgcaactttaccaattaaaggcaaaccttcttcatcgtttgctgcttcatcttccactaaaatacggatcccacgcgaagtccctgaaagcatttcaatatagcctttacgagcaagggctttaaggtgttcttctgcggcatttggtgatttaaacccaatttcacgagcaatttctacacgagttggcggcatacccgtactttcaatatgattttttacaaattcaaagatttcttgctgacgagccgttaggtgctgacgtttcataagttcctcactgtctttatatacagaaatttatgacattatatacagtaaaatttcatttgcaacgaaataattttagatttctgtaagaaatgaagaatggagttagcttaattaacggcacggacacactgcgtgtgcccgttttcattagttgaaatgattgcaaagacagctcgcttggtgtccttgtttattttgtattcaattctgcatatttatcacaacctgcttgacttcccatatcgcaagaaatgccaaaataggctttggcataatattttaaatccatatctagaaaaaaaacatttgcctgtttgaaaaagcgttcagcaccattattagcctgtaattcttctctaatctgttggattttatcttgggcaactttatcaagtatctcatctttgtctttaagaacaactaattccatttttaagtgttcaatatccttaaaaacttctttggaatattgatcgcgagcatgattctctagtaaagcaatatattctgttaagattttttccgctttagcaatatctggggttgttccaatacctaaataatacaatatggcaagtctctggtaactatttctgtaaatattaaaattatatcttttagtattttcataatatttatcagcccaataaaatgccttttcccagttatggttatctttatcattaaaatagaaatcgattaaatccacctgagcacgaagataacccattttagctaattcttctaatacagggatatttttatagtcatattttgccggcatatctccaagtgatgctgctttagctaaaaatgtttttctttcataactgtcagaatcataggtataagctaatgatctatatgctggtgcaaagttttgatttgctgcacggctaaaccatttttttgcttcctctttatttttttctttccgataatacctacccaattgatattgtgcaatcggataatttttttccgcaagctgttttaatctatcgattgggaaaatatctaattctgctttagctaacttatcaccataaaaatcaatttgatgaattaaggtttctaatcggttaatatctttatgttcgggataaagctgtgtgtaataataaccaccgccacaaacagcagcgagtaaagtgagtgcggttagaattttggttgtttttttcattttataatcctttaatgttgagtaatgttattaattgataatttaagaatgttctgtaatttatttttaatacttactaaaacgttgttttgctgctgcaacgacactatgctgtttattaaacaaacttatttggggaaagtctttaatgtctgcaaataagtgtttagcttggttaaaaatatcttcctgcacactattacgcttcattttatctaattccaataataaattactcaatgaaataatatgtttttgttgaaacttagaactatcagcccccaattgttgataaatctttatttcttttagccaacttgaaaaatatttgtcgtttcctcgttcagttaattcaccttcatctaggcaatctttaaatgccaaaaatttctccaaataaagttcagcaagttcggctaaaatttgttttcttttatttcgttttaatgaacactctaaatcttcataattatctaaatccaccgaattatttaatgcaatattttcaattaattgttcatcttttcggcttgttaccgtttgaataatttgctcttctctttcggataattgttcgattttacgttgatgttttgcaaattctaactttaagttatccaattctttttttgcattatcggattctctgataaaactttgataacttaacacagcaggtacaactgtacccgctgtgattaatacccccaaaagcgtaaacactgaagtcgctgcttcccaagcaccttccgctttatacttgttagaaacagcttcaatactaaacgctaataacgcagcagccagaatactgaccaccgcccaaaaatgacttttattagattccacgttaattagtatccatcttcgctgagtttacgataaaaataacaagcaacttgttcgccattatcacaagcttttccaaaccacattttggcggtggagctattttgtcgaactcccgatcccaggttatacattgaccccagtgcagcttgagcctttgcatctccttgttcagccgctttttgaagccatttgacagcttgatgataatctttgctaacaccttgacctttgttgtacatcaaagctaaattaaattgagcctctgcatatccttgttcagccgctttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccatttgaatgcttgatgatagttttgtttaacaccatccccttctttatacattaaacctaaaatagcttgagcctgagcaacaccttgctccgctaattccttaaaaagaggaaaagccacttgataattttcttgttcgatatattgatatgctctgttaaatttctcttctgcgtcttccgcatacacattcccaacgaagacaaaagagagtaataaggtagagagtagggttttacgaagtgtcattttgttttccttttgactatggttttaagacgacaaaattgtacaaaaaaaaaacaaaatgcaatcaagatgtaatcagcggttttttgttggaatttatgacaaacgatggatttttaggcagttcttggagttggttccggcattgttccctacacctattctcttaaaatgggctttggggcgaatgcgatataatatctttcttattcctcaacttttatgaataaactcagatttccttaagaaatttatgctaaactgcgcatcgttttaatccgatcataactataaaaggatataaaaatgtctatgttattaaacctgtatcgtaaagcattgaacctaccgctttcgctgttagtgaaaacacgttcaattcctacagatcctgtgaatgaattagggctgaagttagatcaacctattgtgtatgtgttgccctacacctcacaaacggatctgttaattttgcaaaaaaactgccaagctctgaacttgcctgatccgctggtaaataatgatattcaaggggtatctttgtctcgttttgtctttttagatgaagggcgtcgtttctttaaatccaaaggggcgaaaagtgaaacagagttggttttctatcgttatttagatttaaaccgtaatgatgagcagttagacattcaagttgtgcctgtctctgtgctttggggacgcgcaccgggtaaagagaaaggtttgccagtattacgtctgctgggaactttccaacgcttagtgacaatgctttggtttgggcgtgataattttatccgtttttcacaagcggtttctttacgctatatgattaccaatcacggaaccgatgaaaatctggctcaaaaattggcccgtgtggcaaaaatgcattttgctaaacagcgttattcggcaacaggtcctcaactgcctgatcgtcaagcgatgttcaataaattactgcaatcccctgcaattttggctgcgattgaagatgaagcgaaaaaaccaaaaagttcgcttgaaaaagctcgcaaagaagctgagaaaattctggatgaaatcgctgcaaatgttcgtcacgacagcttaagaagcgcagatcgtgtgttaagttggttgtggaataaactctatcaagggatcaacgtgcaatatgcagagcgtgtgcgtaaattggcattagaaggacacgagttagtatatgtgccgtgccaccgtagccatatggactatctgcttctctcttatattctgtatcatcaaggcttagtgccgccacatattgctgctgggatcaacctaaacttctggcctgcaggtcctatttttagaagttggggggcgttctttattcgtcgtactttcaagggcaatcgtctgtattctacgattttccgtgaataccttgcagagctgttctaccgtggttattccgtagaatactttattgagggcggtcgctcacgcacagggcgtttgcttgatccaaaaacaggaatgatgtcgatgacgttacaagcattgcaacgtggcttaactcgcccgatcagtattgtgcctgtttatattggttatgaacacgttttagaagtagatacttacgctaaagaattacgaggtgcagagaaagagaaagagaatgctggcttggtgttacgtgtgattaagaaactgaaaaaactagggcaaggctatgtgaattttggcgaacctattccacttaatcactatctcaatcagtattttcctgaatggaaagaaccgcttacagatgaaaatggtcgtccaaaatggttaaatagtgccgttgaagcggtatctaaacaagtgatggtgcatattaataatgccgccgcagtcaatgcaaaaaatctcattggctctgtgttgcttgcttcacgccaacgttctttaacgcgtgaacagcttattgagcaggttgaaagctatatgcaactgttcaaaaatgtaccttatacagcggaagtcactttgccaacggatacagctgaagcgatgttagatcacgttattaatttacctcgttcaggtgttatctcagaaaaagacaactttggtgaaattatccgtttagatcgtcaatctgcagtattaatgacctattatcgcaataacattcagcatttatttgttttgccatcattggtcgcaagtattgtgttacatcacgagacggtatctaaagatttgattatccagagtgtaaatcgcatttatccgttcttacaagcagaactctttatgcactttaaagcagaggaagttcgtgggcatattgaggcaattttagcggaatttgttgctcaaaatctgattaaaaatgaaagcgatatgtttgtgattaaccgccaacgtatccgttcattacagctacactcttcaggtgtccgtgagttattacaacgttattacatcagcttgagtattttgattgagcaacctgaaattagtcgaaatgagcttgaacaagaaagccgttcaattgcacaacgcctgtctgtgctacacggtattaatgctccagagttctttgataaagcattgttctcgacctttagtgccacattgaaagaacaggggtattttgatgaagaaggggatacgattgtatcaaaagttcaatctattgaagagttgatcagaggattgatctccgttgaaattcaacatactgttcaaggagcgatggtcaagttggaagaggtaaataatatataaatatagggagctttctaattaaatattgtaggaatacttggtgagttgtgttcctacatttcttttcttgtggaacagctacaaaatataaaattttttgcaataaccgaccgcttctatcattttttccttgtaattcctgcaaattttgctacattccacaggttgtttttcttgtttaaaaggtcaaaaaatgaaccaacaacttgagttaatcaaatcttccattaaatctattcctgactatccaaaagcaggcattatcttccgtgatattacttctttattagaagtgcctgccgcattccaagcctctgttgatgcaattgtggctgagtttaaagataaagggatcaccaaaattgtgggggctgaatctcgtggatttatctttggtgcgccagtggcattagctttaggtgtgccttttgtacttgtgcgcaaaccgaaaaaattacctcgtgcggtaatttcgcaatcttatgcccttgagtacggcgaagataccttagagatccatacagactctgttcaagctggggataatgtgcttgtcattgatgatttacttgcaacaggcggtacggtggaagcaacagtacaacttattcgccgtttaggtggtacagttgagaatgcagcctttgtgatttggttgcctgatcttgacggtaaagaacgcttagagaaaatcggtgtcaattcttataccttagtgagctttgaaggtcactaatcttatatttctccctttgcaatcccccctttgtaaaaggggggttaggggggatttcaagagctacgcaacatctaaagaggtcaaatgtcctatcaagttctagcacgcaaatggcgaccacagcggtttagcgaagtggtcgggcaacaacacgttttatccgctctcgaaaatggtttgcgagaagggcggttacatcacgcttatcttttttcgggaacgcgtggcgtagggaaaacgtcaattgctcgtctgtttgcgaaaggcttgaactgtgaaacggggatcagtgctgatccttgtggtcaatgtgcgaactgtaaagccattgaagaagggcgatttatcgatctgatcgaaatcgacgctgcttcgcgcacaaaagtcgaagatacccgtgaattgctcgacaatgtgcaatacaaaccaaccgtcggacgttttaaggtctatttgattgacgaagtgcatatgctctctcgtcacagcttcaatgcgttattaaaaacccttgaagaaccgcctgaatatgtcaaattcttacttgcgaccacggatccgcaaaaactgccgattaccattctttctcgttgtatgcagttccatttgcgtgcgttggaacaatcgcaaattcagcaacaccttgaatttatcttaacccaagagcaaattccctacgaattgtcagcacttgctaaactagcaaaagcggcacaaggcagtattcgtgatgcgttgagcttaaccgatcaggcaattgctgtcagtaatgtgaatatcaccttgccgattgtaagccagatgctcggcttaattgacgatcatcaaccgttagaattggtgcaagcccttgcgaatgccgacggtgaaaaagcaatggcagtgattcagtctgtggcggaaaaaggtgtcgattggcaacaactgttaagcgatacggcagaaaccttgcaccaaatcgcgatgttgcagttgttgaaacaccctcatcaagaagaaaccccactgcattttttagcaaaacagatctcgccagaagatgtgcagtttttctatcaagtaatgcttacaggcaaaaaagagttgccttttgcccctgagcaacgttcaggcgtggaaatgactattttaagagccttggctttccaccctaaaaatattgcaaccacgataaaagttgctacacctacaccaacaacgcccgttgcacctgtgcaatcgccaaatagcattagccagttaagagaacgtttagctcaacagcaaaattcagctcaaactgtgacaacacaagcggtcaaaactgaacaacattttgcaaaaaatctctctcaaccaaccgcttccccaactgaaacgaatacagaaagcatatcgcctgccttaaaagcaatgcaagctcgtcagcaattaaaagcgaaacaagagcaacaagacgaaaaaaaaaagtctgatttaactcccattcaaccaccaaaaacgatgaataaaaagagcgttcagcaaggtttaatgaacctagtgaccgctcaagatcaacggcaacaagtcgaaaaaacacctcaaaaaactatcgcttcacaaaatgatgaagactaccgttggacttggcttaatcctgagttagaaaatcaagaggaagccccgaagccttcagaaattaagcaagccattttgcaagagcgaacacctgagctagttaaaaaaacgattgagcttggttgtgaacgagataaatggagccgaattgtaaacagtttaaaactgggcggagtttctcgtcagctcgctttaaacagctatttagaaagccataacaacaatcatcttttgttggttttaaaccccacaatggcacatttaaacagcaatgaagcgacccaaagtttatacaatgccctctcacaacaaggctttagtagtgaaatgcgaataggcgaaagtgatgagttccaaaccccattagaaattcgtcgagttatttttgaacagctcacgcaagaggctaaacaagcactacaagcggacgaaaagttaaaacttttacaacaagcctttgatgctcaaatggacgaagcaactattcgggcagtagcggagtagaaaatatgtacgcactcgaaataaaaaacctaatcaaacaatatccaacaggtgttcaagcccttaaaggcatagatctctgtgttgaacagggagacttttatgcattgcttgggcataatggtgctggcaagtccacgacgattggaattattagctcactagtgaataaaacaagtgggacaataaaagtgtttggttacgatcttgataaacaaaaaattcaattaaaacaacagattggattagttccccaagagtttaatttcaatcagtttgaaaaagtgatcgacgttttaattaaccaagcaggattttatggcattaagcgtagtcaagccttaatccaagcggaaatttggttgaaaaaattagacttatgggaaaaacgtgatcattttacccgtgaattatcaggcggtatgaaacgccgagtgatgattgcccgtgcattaatgcataaccctaaactgctgattttagatgaaccaacagcaggggtagatattgaacttcgccgtagtttgtgggattttttgcgagagcttaatcagcaagggacaaccattattctgactacgcactatttagaagaagcggaaactctgtgccgtaatatcggaattattcagcaagggcaaatcatcgagaatacctcaatgaaagcgttattggcaaaactcgaaacggagatctttttgctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagatttaagtgaaaaccgaccgcttgttattgacggttatccgtttaaatgggtagatgaaaccactatcgaagtagaagtaaaccgaaaacaagggttaaacaacttattccaacagcttagttcacaacatattgaagtgttaagtatgcgaaataagtccaaccgcttggaagagttgtttatgcaattaaaatagccaataaaattagataaatatatgatcggattttcaacactcgcagtaaaagaaacaaaacgtgtcttacgcatttggcgacaaacattagtaccgccaattattacaacgacactctattttttgatcttcggtaaacttatcggacaccgtatcggtgagatgagcggtgtaagctatatgcaatttattgcccctgggttaataatgatgtcagcaattaccgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgtcagcaattaccgcttcttacaccaatacagcttcatcatttttcctaagcaaatttgttcgcaacattgaagagttgcttgtgtcaccgctatctacccatacgattatttggggatatgtggcaggcagtataatgcgaggtgtaatggtcggtatccttgtgacagcggtgacattgtgctttgtttcttatcaaatatactcttggggcatcattatccttacgatgttgatgacgactattgcctttgctctagggggattgattaatgccgtatttgcaaaaacttttgatgacattggcattatcccaacctttatactaacccccttaacctatcttggcggtgtgttttattccattagcttattgcctgaattttggcaacaagtgtcccagtttaacccgattgtttatatgatcagcggttttcgctatggttttttaggtattagtgatgtgtcgatctactatacttttgcagtgttaatcttatttatcctagcgctttacacttgggcttatcgcttaattgagagaggggttgggttaagatcttaagagccaacaagacagatacccagaataatctgttgtttatcttctctctttatgaacaaccttgacaagaccgataaaaagagcgataaatggcactaaaaaaaggaaggattattatgccaagtgttattttaaccaatactgttgcgagtattacagagctaaagacaaatccaatggcgacattcaatgcggcaggcggtgaggcaattgcaattttaaaccgaaatgaacccgctttttattgtgtaccaccgcatatttatgaatatctcattgagcttgctgatgatgcagaattagcaaaattagtggaagaacgccaacacgaaaaaagctacaaagtggatttagcggatttattaaaatgagctataccattgaatttatcccatcagcagaaaaagagttccgtaaactaagcttagatttaagaaaacaatttatcgaaaaacttaaagaaagagctgaaaatccgcgtgtagaaagtgctaaacttcgtggaatgaaagattgttataaaatcaaattgcgtaatgcaggctatcgtttggtatatcaagtgattgatgaacgtattgtaatcaaagtggttgcacagggaaaaagggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgtttaccaaaaagtacaattacgtttataaaaatataatttgaaaccataaaaaaacccgataccaaaaaacggtatcgggggaggtcttacctaaggaaatgaaaaataaaactagcacattatgcgtattctaagactaccccaataaaatttagttcaataaaatgctaaaaaatttaaaaaaattatatcttattgaaataattaataaattaatgagataacgaggcgaataaatggttcaaaccaccttttttatttacgattacgaaagttttggtgtcgatcctgctacagatcgtcctgcacaatttgcagggatccgcaccgatagcgatttcaacattatcggtgaacccgtaatgttctactgccaacaaacagaagattatttgccttcaccagaagctgtgatggtaacagggattacgccacagctttgtaatcaacaagggctacctgaacctgaatttgccgctcgtattcacgccgaatttagccaacctaacacctgcgtaatgggatataacaacattcgctatgatgatgaaatgacccgttatacctttttccgcaattttttcgatccttatgaatatagctggaaaaacggcaattctcgttgggatcttcttgatgttgtgcgtgcctgttatgctttacgtccagaagggatagaatgggcgtatgatgatgaaggtatgccgagctttaaattagaaaatttgaccaaagcaaatggtattgctcacgacaacgctcacgatgcaatggctgatgtgtatgctactattgcaatggcaaagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgtttctggaatgttaggcaactatcgaggtaacaccgcttgggttgtgccattggcttggcatccgactaatcgaaacgcagtgattgtatgtgatctatcggggaatataaacgacctattgaatgagccaagcgaaatattgcgtgaacgtctttataccaaaaaagtagaattagaagctcaagggctttatgctattccgctcaaacttgtgcatattaataaatgcccgattttagccccagccaaaacgttactgtctgaaaatacaacacgtttaggcatcgatcgtcaatcctgtttagaaaatttaaaactgctaaaatcccaaaaaagccttgtgcgagaaaaggttattgatatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctgaggaaaggaattatccagcgtcaaataatatagaaaccacgttatacgatggcttttttgaacctgcagataaaaacaatatggcgattttgcgaaatctaaaacctgaagagcttgcacatcacggcttgaaatttagcgatccaagaattgaacctctacttttccattatcgagcaagacattactcagaaaccttaacacgcgcagaacaagtacgctggcaaaagtattgctatcaacaacttgaagcaaaagcagaggcctttgatcaagcggttgatctgttatcggctcaatatcacgataattctgaaaagataaaattattgacagatctcaccgcttacgcagcacaattaatgcagcctaaagccaccaagtccgtcaattcaccagcttcagagctattagtatcggaattaaatcaacttgctgatcaagggctgagtaaagcggataaattaaaagcgattggggctttgcttaataaaaaataaacttgttctcgctatagacaatggttaggcaaacgattactatcactccaatttttacaaacacgacgataaggaaaacgatatgaataaaacattacttgctcttgcccttgtggctttttctgcaacttcttttgcaacaacaaacggaaaacaagcggtcgcttctgaggaaacaaaagctgcaaatgccctcgtattacaaacagacttcggtttaaaagatggtgcagtatctgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaaggggtggcttttggggttgatcgtgagttaaaaatgtttgatttaactcacgaaattcctgcatataatatttgggaagcctcttatcgtttatatcaaaccgcaacctattggcctgctggcaccgtttttgttagcgttgtcgatccaggcgttggcacagatcgtaaatcggtcgtattaaaaactaaaacaggacactattttgtaacccctgataatggcacattaacgttagtggctgaatttttagggattgagagcattcgtgaaattgatgaaacaaaacaccgcttggaaggttctgaaaaatcttatactttccacggacgcgatgtctatgcttatacaggagcaaaattagcgtctgggcagatcagttttgaagaagtcggtgcagagttacctgccaaagtcatcgaaattagctaccaaaaacctgctattgaagaaggtacattaaagggcaacattcctgtactagatattcaatatggcaatgtttggacaaatatcagccacgaattacttgaacagtcaggtattcaaaaagatggcaaagtctgtgttgaaatcaaagaaacaacggcagatgaggtcaaagtccgttatagtggctcaatgccatataagagcagttttggtgatgttgaagaaggcagaccattgatgtacctcaatagtttattgaatgtttcttttgccttaaatatggataattttgcgggaaaatacaaaattaaatcaggggcagaatggtctgtttctgtgaaatcttgtgaaaaacaacaataaagaaaataatcgtagggacacactgcgtgtgtccgtcaacgtatgtctgttgatacgaattgcggtttttgttggaacgaatggacacacgcagtgtgtccctacaaaatggtatattgttatggttggagggattaaggataattaaatgaaatatgatttacatagccatagcactgcgtccgatggcgtgcttacccccacagaactcgttaaacgagcggtggaacaaggtgtaacaatgttagccttaactgatcacgataccgtcgctggtatcgccgaagcgaaaatgtttgccaaaaaccaaccgcttacctttatcagtggtgtagaaatttctgtgttatgggaagggaaaagccttcacctcactgccttaaatattgacgaaacccaccctgctatcgtcaatttacttgctagccaaaaacaattacgccaagaacgtgcagaattgattggtgaaaaacttgccaaagcaggtgtcccgaacgcatatcaaggggcaaaagccattgcaagcggtgaagttactcgtgctcactacgcccgttttcttgtggcagaaggctatgcacgcaatgatgaacacgccttcaaacgctatctagggatcggcaaaacagcttatgtaaagcccgtatggtgcagcaccgaagaagccatcgcagcgacgcaccaagctggtggcgttatctgttttgcacacccattacgctataaattaacagcgaaatggatccgccgttttattgaagagtttaaacaggctggcggagatggcatagaggtaacgggagccgcccaaacgccagaccagcgtcagcttcttgctcgttgggcaaaagagtttgatctctatgcctctgtcggctcagatttccactacccgacaggctgggttgagttagggaaggatttgatattaccttcaagctgtaagccgatttgggcattgtttagttaattgatttatattaggtgaagtgcatagtaggaaatgattttaactcaaagtgtgtgtactcacattgattgatgttgtatctactatgctatttatttaatcaattttataaactgtttttttcccctcgagccaaactaatcaccccagaacgaacgatttcaataattgttgtttctgctttcactgtttcaataaaagcattgagtttatcactcgtaccagaaagctgaatggtgtattgttttggcgtaatatctacgatttgtccacggaaaatgtctgccattcgcttaatttcatctcgtgtattacccacagctcgaacttttagcagaagcacttctcgttcaatatgttcacaatggctaagatttgtcactttgaatatatcaattagcttatgcagttgtttttcgatctgctccaagacttgttcatcaccttgtgccacaatggtcattcgagataaactcggatcatccgttggggcaaccgtaagactttcaatattaaaaccacgttgagagaaaagcccaacgacacgggataaagcccccgattcattttctaataggacggataatattctacgcatctgttctctccgttttacttaacatcatatctttcattgattcaccacgaatttgcattgggtaaacgtgttctgtttcatctactaacacatcaacgaaaacaagtttatctttaattgcaaaggcttgtgctaatttttcctctaattcatcaggggtgttaatttgaataccgacgtgtccataagcctctgccagtttgacaaagtcaggtagtgaattcatataagattgggaatggcgacctgcataaataatatcctgccactgtttcaccatacctaagaagcggttgtttaaactcacaatcaccacaggggtatcatattgttttgccgtagaaagttcttgaatattcatttgaatactaccgtcacctgtgacacaaacaaccgttgcttcagggtgtgcaaatttcactcccatagccgcaggtaagccaaagcccattgtgcctaaaccaccagagttaatccaacgacgcggtttatcgaaaggataatgtaacgcagcaaacatttgatgttgtcctacatcagaagcaatataggcatcgccatttgttaatttataaatggtttgaataacctgttgaggtttaatcacatcactttgctcaaaacgtaaacattgacgagctttccactcattaatttgttgccaccaagcggtcagatctgattgaccttttgccagattttcttcacctaacaatgctaaaaattcttctaatacaaattttgcatcgccgacaatgggaatatatgcagggacggttttagaaatagaggtaggatcaatatcaatgtggatcactttagcatttgggcagtattttgcgagattattggtagtacgatcatcaaaacgcacaccgatacccaaaattaaatcactttcgtgcattgcattgttagcttcataggtaccgtgcatacctaacatacctaggaattgcttatctgtacttggatatgctcctaatcccattagagaacttgtgacaggtagatttaatttctgagcaaattcgatcaactctttatttgactccgaaatcactgtaccgccacccacaaaaagtacaggttttttagccactaagagcacttttaatgccttcttaatttgccctttgtgtccttgtagcgtggggttgtaagaacgtaatgatacagaatcagggtagtagtaactgaatttatttgctggatttaccatatcctttggcacatcaataacgacagggccagggcgacctgttgaagcgatataaaatgcttttttgatgatctcaggaatttcttctggattggtgacgaggaaactatgtttaaccacagggcgagaaataccaaccatatcacattcttggaaagcatctgttccgataaggcttgaaggcacttgtcctgaaaaaacgaccagtggaatggaatctgtgtaggcggttgcaatccctgtgatcgcatttgttgcccctgggccagatgtgactaatacacaaccgactttacctgtagaacgtgcatagccatcagccatatgtacagccgcttgttcgtgacggacaagaacgtgtttgattccacctaaggtgtgaattgcatcataaatatcaaggactgagccacctgggtaaccaaaaacgtatttcacgccttcgtcacgcaaggattgcacaatcatttccgctcctgagagttttttcattgaatcctccaacaaaattaacataaggtttacaccataaaaacaatgttgggcattttgcaaaaaatctgaccgcttgtctagccattaaaaacaatgttttctttaatttttagatttaaattctaaaaaataataaaaattgattttttataaaaaaatgttgttcttttatttatttttattaatataacttatattttataaatttttataggtttattgttaggtctttttactaaaaagctccgtgtgagattaaaaatcttgtacactgaaatacatttctattttcaaatattgaggtatttatatgcaaaactacaacattgccgtgttaagtggtgacgggattggccctgagattatggctcaagcgattaaagtgcttgatactgttcaacaaaagtacgggtttaaattaagttataactattatgatattggcggcgttgccattgataatcacggaaaagcattaccagaaagcacattaaaagggtgtgaagaagccgacgctattttgtttggctctgtaggcggtccaaaatgggaacatcttccaccaaatgagcaaccagagcgtggtgctttgttaccacttcgtaaacactttgcattattctgcaatcttcgccctgctacactttataaaggcttagaacaattttgcccattgcgtgcggacattgcagcaaaaggctttgatatggtaacagtccgtgaattaacgggtggtatctattttgggcagcctaaaggtcgtgaaggcgagggagaaaatgagaaagcttttgatacggaagtttatcaccgttatgaaattgaacgcattgcaaaagtggcatttgaaacggcaatgaaacgcaccaaacatgtgacttctgtcgataaagccaatgtgttaatgagttcaattctttggcgtgaaaccgtaaacgaagtagcaaaacaatatcctgaagtgaaattggatcatatctatattgataatgcgacaatgcagttaatcaagcaacctgatttctttgatgtgttgctttgctctaatatctttggcgatattatttctgatgagtgtgcgatgattactggctctatgggaatgttaccttctgcgagtctaaatgaaaaaggatttggtttatacgaaccagcgggtggttcagcgccagatattgcaggtaaaaatattgctaacccaatcgcacaaattctttctgcagcgatgatgttacgtcatagttttggtttggaagaatctgcgaaagcgattgaaaatgcggttcaaaaagtattagccgagggttaccgcacggcagatcttgctgatcatactacgatgcccgtaactacctcggagatgggaaatttgatcgaacaatatattggataaggttataccattttatttatggttaagaaggtacatgagttcttctaaaaacagtatccaaagtcacgataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttgctaatatttattttgtctattacaccaataaattacatcttttattaaaaaaggttaaagcttcatcaggctttaacctttttactatgtcgctatgtcttggctactgcactatcaaaaaaataagcaacccttaccgagttgcttattaattttaccgctacatcaggaattagagtttaatccttagcatatttcgcttcatcaaactctctcaacggcttatgctcactgcctaaataggtgtagatcacaggcaatacaaacagcgtaaagagtgtaccaatacctaaacctgcaacaatcaccataccaatactaaagcgagcaattgcaccagctcctgaagcataaagcagaggaataagacctgcgatcatcgcggcagtcgtcatcataatcggacgtaagcggatagttgcagcgtggaaaatagcatcacggcgagattttccgtgaagcaactgctcttcttttgccacttcacacatcaagataccgtgtttcgttattaagcctacgagggtgattaagcctacttgagaataaatattcaaggttgcacctgatactttcataatgcccaaaatattcatcaccaataatgcaccactaattgctaacggaacagaaactaaaatcaccaacggatcacgccacgattcaaactgaatagctaagacgatataaatcatcacaactgccagcacaaaggtaaacattaatgcgttaccctcttggatatattgacgagattcagctttaaaatcgtattgatagcctgatggcaaagaacgagctaactcagcttcagcccattttacggcatcaccaatagaacccgacaccacaccgccaattgttgccgagttaagctggttcattcggctgagggaagctggttctgtacttaattccattgtgacaaaagaacccaatgggatagattgtccgctcgctgttgtcacatagtagttcattaaatcttctggatttaatcggtcatttctcaccgcttgcgatacaatcggataagctctggaatcaatatcaacacgagtaactatagcccccgacaagaacgaacctaaagtgccactcacctgttgcatcgttacgccataagtccccattttttcacggtcaaacttcatcttcatcgttgccgtgttaaatttaaggtctaagttagcgaagaaaaattgccctgacgcttgtgctttggctaaaatttcactggcgacttctgcaagtttttcatagctatctgcagtcgtaataaccagtgagaacggcagcccactttcacctgtctgaatttcagggaaagcaacggcgttaatatccataccaaccacttgttttgccatacctgcaacaatgtctttcacttcaaactgcgatttgctacgttcagaccaatcttttaaagagataatcgacaatgaactgttgccaccgttaaagcctgcaatcgacattgcgccgtgaacctcaggcaatttaaccactttctcattaaaaggtttcatcacttcctgcgtatagtccaagttagtatttgcaggaccagatccaaaagcaaccacaacaccacggtcttcagaaggtgcaacctcactagacaatgaagtaaacaagaacggtaagctcgcaaaaatagcaatcgcaaagaacagcataaagccacgaactgccatcactgctgaaagcatattttgataacagcttgtcatcttatctaacatagcgtgaatgcatttgactaaacgcccttcttcaccccctttatgttcttttaacacacggctagacatcatcggcgaaagggttaatgctgcaatccccgaaataaatacagcaccagcaagggttaaagcaaactctttaaacagagatcctgtaaccccttccattaatgccatcggtgaatataccgccgcaagagtaatggtcattgaaatgacaggcaatgcaatctcacgcgtcccaataattgccgcatcgaaaggcgttttaccctctttaacgtgacgctctacattttccaataccacaatcgcatcatctaccaccaaaccaattgccaaaatcaatcctagcaaggtgagcaagttgatcgagaacccaagcatctgtaataagaataacaccccaatcaatgaaatcgggatagtgataacagggataatcatcgcacggagtgaacctaagaataggataatcacaataagcacaatgattgttgcttcaccaatggttttaattacctcagaaatagagctattaatcgcaatagtgctgtcatacaaaatctcagctttaatggaagcgggcagattcttctcaatttgtgcaaataacggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaataacggatagatatttttggcaacggttaatttgtttgccgttgctgcagactcaacagcaatcaccactgcatctttgccatttgctgtggctcgagcattatctgaagatttattcagttcaacggtcgcaatatcttttaacttaatttgcataccatctgctttggttgccacagtaatatttgccagctcttctaccgttggagttgtcgataacaccttgtttttatagacagtgtaataaccatttgcactgcctgccgccgtcgaaaggttatttgcacttaatgccgataacacattcgcacctgaaaggttatagccagccattctatctggatctaaccaaatgcgtaagccaaaggttgaaccaccaaagataccaacgctagacaccccattgatcgtaaaaaattgcggtttcaccacgcgatttaggtagtccgtaacttgtggagatgaaagatcatcagaggtaaaacgaatatacataaacgcatcatttgatcccgatgatacgctgatcgcaggatcatcaatgccactaggcaagcttccacgaattgcatttactttagaagaaatatccgataacgcctcttgaggattggtatttaacttcatctttgccgttaccgtcgtagtacttggtgaacttgatgaagtcatatagtcgatgttatctgcctgtgcaacagcttcttcaatttgtgacgtaacaagtgcttgcattaaacttgcatctgcacccgcataattaacactcacagtaacaattgagatcgtcatctcaggatattcacgcacttgtagcttgctaatagactgtaagcctaagattgtaatcaataggctaatacagatagcaagtacggggcgtttgataaaaatgtcggtaaatttcacagcttaccccattacagttttgtttttgtcgctggtgcaataaccccaacaggttgcacatcagaaatttgaattaaggcgttattttttaaacgttgtaagccaccagtgacaatcacatcaccggcttttaagcctttgctcaaatgagaatagactccactgcgttcagccgtcgtaacttccatctgtttagcacgatagattttattgatgtctaaacttttgttcatttcagccattttagtcactttttccttatcttcatcagataatggttgaagcacataaacagtttcgccatacattgtataagtaaccgcaatttgtggcacaacaacctgatcgtataaggttggtaatgcaacatttaagcgagcaaacatacctgaaagcaacttatcttgcccttctgtgaccactgcttcaagattaatcaaaccagttgatgtatccaccgcaggatcgatagcggtaattttcgcagggaaagtacgagcaggtagagcatcaatggttgcggtcactttttgcccaacaaaaatatcttctaagttagtctgaggtaaggtaaaacgaattttcatcgcagactgatcttccacacgcacaattcctgtgccaatcgtcacatattgccctacattcacattcacaatacccgcttcaccgtcgaaaggcgcataaatttgacgacgctcaatctgagcttttgtcgcctcaatagtcgccacaagttgctcataagttgctttggcattatcaaattccgcttttgaagcactgcttgacgctactaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactgcttgacgctactaagttacgatagcgattatagtttgctctcgctgtcgataactgagcttctgtcgctttcaaactggcttgttccgcactgctatcaatttcaactaatagctgaccttttttcactttatcgccagacttcaccaaaactttagtgaccgtgccagccgcctgtgaacttaacatagccccttgattcggacgaatagatcccgttgatgcaatcatcggtgtccattctctcccctccaccgtcatcacagtcacttggctcaccgtttcaggcatattcgccgcagcttcagcctttttcatcgaaataaactgttgcataccaacaacaccaccaaacacgataagcacaaccaataaggtcacaacaatagcaaactgcttacccttcgttgtctttttcatatttattatcatattttctccatatcaattttgattaaatcgtaatcgctttccaagtacggataatcacttcttcaagcatctcttgagcataaggttgatttaacattaactgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattagggttatccaacataaactgccaaattgcattccacaattttttatattgctcaaacagaggcaaatcaggatcatattcccgatctaccgcagaatgaaacgtattaaacaaatacaacacaagctgattaagcaaagtctctttatccttaaaataaagatagatcgtacccacagataccccagcttcttttgcaattttgcgagtcgaaagattttgaaccccttcttttgccatcaacctatctgttgcattgagaatacacattgccacctcattttgaggcaaaatacccttaaacataaaaacaagtcaagttactgaacgttcgttcattctacttagaaaaaaagattttcgcaaaatctaaagttcaagttttgtaaataatggatttacgcaaacgattgcgttataatttaaccgaaaatattccacagatcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaagaggggagatcgatgattaacgttcaatcaatacacaaaggaacccataatggctcatcgtccaatccaacaagtattattaagtgtgtctgacaaaacaggcattgtcgaatttgctcaaggcttagttcaacgtggtgtaaaactactctcaaccggcggaacagcaaaattactcgcagacaacggtttacctgtaaccgaagtatcggactacacaggcttcccagaaatgatggacggacgtgttaaaaccctacacccgaaagtacacggagggatcttaggtcgccgtggcacagacgatgaaattatggcacaacacaacattgaacctattgatatggttgtggttaatctctacccctttgccgccaccgttgccaaaccaaactgcacccttgaagatgcggtcgaaaatatcgacatcggagggccaacaatggtgcgttctgcggcgaaaaatcataaagatgttgcgattgtcgtcaataacaacgactttaacgctattcttgctgaaatggatcaaaaccaaaactcactcaccttagaaacccgtttcaaccttgcaatcaaagcctttgaacacaccgctcaatacgactcaatgattgccaactacttcggacaaaaagtaccgccatatcaaggtgctgaggaagaagatattacccaagtctgcggacagttcccacgcacattaaacttaaatttcacccgtaaacagacaatgcgttacggtgaaaacagccaccaaaatgccgcattctatgttgaaaacgaactcaaagaagcatctgtggcaaccgcagttcaactgcaaggcaaagccctttcttacaacaacattgctgatactgacgcagcccttgaatgtgttaaagaatttaacgagccagcttgtgtgatcgttaaacacgctaacccttgcggtgtcgctcttggcaaagatattttagaagcctacaaccgagcttaccaaaccgacccaacgtctgcctttggtggcattatcgcctttaaccgtgaattagacggcgaaacggcacaaacaatcgcagatcgccagtttgtcgaagtgatcatcgccccaaccatctctgaagcagccaaagaagccttagcgaaaaagaaaaacgttcgtgtattagcgtgtggcgaatttagcgaagcacaaccacgtttagacttcaaacgtgtcaatggtggcttactagtccaagatgccgatcaaggacaagttgctgttgaagatttacaatttgtgtctgaacgcaaaccaacccaagaagaattagaggatttactcttctgctggaaagtagcgaaatatgttaaatccaatgcgattgtctatgcgaaaaataaacaaacgattggtatcggtgcgggacaaatgagccgagtgtattctgcgaaaatcgcagggatcaaagcggaagacgaaagtttacaagtggcaggctgtgtaatggcatctgatgccttcttcccattccgtgacggcattgatgccgcggcaaaagtcggtattacttgcgttatccacccaggtggctcaatgcgagatcaagaagtgatcgacgccgccaacgaacacggaatggcgatggtattaacgggaatgcgtcatttccgtcattgaaatccctatcagccttttgggaatcttcctccgtaagcgggggaaggtatgaaaacaaatatattctgaagatatttatgatgtaattcgctcgaatccagattcaagatcagcaatcaaatcttccacatcttccaaaccaatatgaacacgaatcagcgtccctgttaatttacgttcaatggcggggcgaatacgctcaatctctttaggttgattagccaaaattaacgactcaaatcccccccaagaatatgccattgagaaaacctcaaaatggtcgagaaaattcgcaagctcttcatcagataaagttttgcaaagttcaaaggaaaatagaccgcttgaacctttaaaatcacgtttaaaatatgcgtttcctggacagctaggtagcgcagggtgataaaccgctttgacttcagagcgttgagccagccattgagccacaataagactactttcttcgtgttgttttaagcgaatacctaaggtgcgtaagccacgagcggtgacataggcagaatcagcatcaaccatttgccccattaaataagagtgttcgcgtagctgatcccaacaacgagcatttgaaacggcagtaccaatcatcgtatccgaatgtcccacaaggtattttgttccagcttggatcgaaatatcaatgccgtgttcaagggctggaaaaagaatgcctgcagaccaagtattatcaatcataatcacaatttcaggatttattgctcttgccgtacgaacaatcgctggaatatcaggaacttccattgttaatgaacttggtgattcgagaaaaagcactttggtatttggctgaataagcgttgcaatgccttctgcaattaatggatcatagaaagtggttgaaacgcccattttcttcaatacgatatgacaaaaatcttgcgttggttcataggctgccccagtcattagaacgtgatcgccttgttgtacaaaagataaaatcgcattactaaccgccgctgtaccgcaagggtaaaggtagcagcctgccccattttccagttcgcacattgcatcttgtagagcaaagtgggttagcgtaccacgtctgccgtaaaataaagcccctttatagcggtttttagtcgcttcttttttatctgcaacagagtcaaatacaagggaagaggctcgttgaataacgctatttacagaaccttgggtgtaacgtttttttcgccctacgtgaacaagttgagttgctaagttgtgctttgtcatattgatgtccattttttatgttttgggtttacaaattcagtgcctttattttggtaagaaataccttctaattcaagtagataacgtttagcaggaagcccaccaccaaaaccagtaagcacttgagtcttacctagcacacggtggcaaggtattaaaattgaaattggatttcgtccaactgcaccgccaacggctctaacggcgttaggattatttaactgcttggcaatatcgccgtagcttactgttttaccataaggaatctcaagcaatattttccagactgcttgctgaaaagcagtaccctgagggtttaaaaaatctagctgacaaaacgccacgttttcccctgaaaaatagcggtttaatacttgcactgttttgcaaaatagttgttgaatttcaccgcttgcctgttctgaacttttccattgttgaaggttaagtgtttgttgctcttgttcaaattcaatgccaagtaaacctgtttggtttgcaataagaagcaatctccccactggcgaatgataaaattgatagaagatctgaaatttcataggattatcctaaaacaaaaggcgtgccacttagtgtacacgcctcaggctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaataatctgacacgtaccacttagtgtacacgcctttgaggttacatcaaatgaaaattagaatttatagtttacgtttaagccgtaaaggttagcagttgacttaactttaaaggtaccctctgcatttattacagtaccatttggaagtcttgttactgcttggctttcggtgaattcgtttttgctaccacgtaaatgcgcataagcgaggtcaacagataaatttggagtaaaacgataagttgcacctaaagtgtaccatgtacgatctgtatcagggattgagatagatggatgtgccacgcttgcactttcatcataagcaatacctgcacgtaatgttaatgcctcaatcacatcataagacacgcctaacgcaatgcgagagttattattgaacttttcatctttttgtaacaacactttaccgttgttatctattgcacgaagttcttggaagctattccaatgtgtctttttatagctatattgtacagccaatttctcagtaagtttatgataacctgagatttcccaatatgctggtaattcaaggtttaagcgacctggaatttcaacattggcactttgagtacccacatatttccctttgaaacgtaaatccactggagaatggtatgcgacaccgaggcggttgttttcgttaatatcataggctagacccacattccaaccaaatccccatttatcaccttttaatcgacttgctgtcgctgtcggtgccataggatttaaagcaccaaaatggcgctctaatgttgcttttgcatgtactgcatttaagcctacgccaaagctaaatccgtagccaagatcataagctccgcttaggttatagtttacagcagttagctcagttttacctgcaaatacgcctgcgctataatttgttgggaattctgatttcaaaccatagttaacattaacaccaccacccacagcaaaacgctcagaaactggtgcaaccacatataaattaggcacaattgcacttggaataatatcttttgcatttgcatctgagacaggtgatgaagctattacattgccatttactgttgttttagtaccaaaagaaccttcaacatcaacatccgcatcaacataaactccaccaacagaaacttctacttgtttgaatttagtcattaatgctgggttggttgcaacaacagaagcattatctgcaactgccgcattaccagcatacgccatacccaagcctgaagttgaaacttcagctaattggaaagccgccgcagaagcatctgccgcagaaaaagtaaagatagaagcaagtgctgttttagtgaatttattcattaggtaatcctttttgattaagtgtaagcggtgagttgtagaatatttttacaaaccaccaaaataaatcgtgcggattctacgaagcttatttcagatgtacaatgaaatttcttccaaacaagcacagttccgaccagtcaaacggcagaaaaagatgtagaaaatgtaaatttaaacctcgaaaatcccttgttgttgttgttgttgttgttgttgttgttgttgttgttgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgttgttgttgttgttgttgttgttgttgttgttgttgttgttgaaaaggtgtagaatgtaaggcgtttatctagttcaactttagaggtcagatatgtccgaatgtaattcaagttcctgctgttctattgatgtgggaactattattgataacagtgattgtgctgtaaattttactcaactttacactactaaagcagaagctgaagacgctttagcatttttaaccagcaaagctggatcaacagaatctgagccttgtgagattaccagtgaaattatttctacagaaaatggcttccaacttaccgcttgttttaaatttagctaccaagttgaatcaatgatttttgagttgggaataagatagaaaaagcattagataaaactcacataaacagctaggcaattcggagcttaatatgaatgaaatcacaagtcttagccaattagatttaaacggcagttatagctatggcgattatttaaaatggaaatttcaagagcgagttgaaattatcaaaggcaagataatggtaatgtcgccagcgcctaatcgattacatcaacggatttcgatgaaattaacaaaagcatttttagatgtttttgttaatcaccagtgtgagttgtatgtagccccttttgatgttcgctttccagacagcaatggcaaaatcaaaacggtagttcaacccgatttgtgtgtcatttgtgactcgaataaattggacgaaaaaggctgtatcggcgcgccagatctaatcgttgaaattctctcccctggtaattcaaaaagagagatgaaagacaaatacgaactctatcaagaacaaggcgtaagtgaatattggatagtccgcccggaagaacaacatatccaaatttatgtgctagaaaacggacgctacataggcgtgcaacctgtggtggaaggcgatgtagttacatcaataaaatttccagcgttaagttttgatacgagtgggttgtatgagttgtgattgaaattaggggagtgtatacaaatatacaaagagatttcccccatccgcccttcgagcaccttcccccgtaaacgggggaagtattaaaaaagtaatgtagtctgaagataaaaattcttcccccatttatgggggaagtccccgagcgatagcgagggggatgggggcatgtaaaggagataaatatgaaaaaagtagccattatcccagcaagagctggttcaaaaggaatcaaagataagaacctacaacttgttggaggaatatctctagttgggcgagccattttagccgctcaagaatcagaggcttttgacgaaattattgtaacctcagatggcgacagaattcttgctgaagcagaaaaatatggcgcaacagcatttcgccgccctgtagaattggctcaaagtgatactagaacaattgataccattttacattgtgtaacaacacttggattaacagagggtgttaccgcacactttcaacctaccagcccattgcgttcaggtttggatattcgtaatgccatggaattattcttggcaggaaattgcaaatcagtcgtgtcagcatgtgaatgtgaacaccacccgtataaatctttcattttggacgaaaatcacaaaattctacctattaatcaattaagtgattttgaagctccacgtcagcagttacctaaagcctatagagcaaatggcgcaatttacatcaacgataccgcaagtttattaaaagaaaaaaatttctttattcccgaagtgaagttttatttaatgccaagttaccgctctattgatattgatacaacattggatctgcaacttgcggaaagtttggtaaacaatgaaagttattaaagatagtgcaatctatctatttggagagttagtttcaaaatcaattccttttcttttactgccctatttatctagaaaattaggtgtagaaggatttggagaactctcttattatcaaacatttttagcattatttgctatttttattggactaagccaagatggtgctgttgcccgctatttttatcgatatggaaaacgttctttagatttagtggtaacaacgggatatgcttatactattacgataggagctttagggctaattgcttgttgggtagcaaagtctgaaattatgttttatttagtattaagtagcatatttcaagtatttctagtagtacaacttagtataagacaatgccaaaaacaagcgcttccttatacgctgattcaattaggctctgcaataaccaatgcagtatttacagtgttgatgttagaaatctatgaaaccgcgttggtagaaaagcgtatcatcgcagtactatgtagcaatatttttattgctgctctagcttatgttatttataagcgaaagacggttactaaaatttttaatatcgcacaatataagctcgcattatggtatgtaattgctttcggatttccaatgatatttcatcacggaagtttctttataaaaggacagttagatagaatatttatttatcacagatttagcgaagctgatcttggtttgtatgcgatgggggtacaaattgcgagtattttgtcggtagtcattttggcaataaacaaagcattagttccttatttatttgaaagattaaaacaaggcacagtaacattaaaacatttagaaaaatgggtaatatattcattatttattgtgccaataccttcattgataacactattaatccccgaacaactctttttatggttgttaggcgaacagtttcagggagtgaaatactatgtcgtattattcttgctttcaacaagtttgattattccctatttgttcttagtaaattatttgttctatcacggaaaaacaaaacagatttcatattgctctgttttatcgacagggatttatttagtagcactaggtggattaatgtttacggaaattagttatattccttgggcgagtgttattggagctggtgggattttgcctgtgttatattttatgacaaagagagttggttagatgaatttgattatttgtatgactccatttcaaatgttaatggcggagaagatagttgaaaaaaaacagagtgagatttttcatttactagtattttattcggtctggaatgataaatatcagtattatatggaaaaagttctttgtaagaagaatgtttttttcttaaaaaaatgttttatttctcctaataatcatttttctcggctatataagtcagttttagtaagaatatatggttttttgttatgtaaaaaatttaataaagtgtatatagcaaaccttgataatccatggattagattacttttaagttcattaggtaaatttgaactatatacctttgatgatggtacagcaaatatttttaaaaacagttttttttataaaaatgattcatttcgtgttaaccttataatgaaactgttattttctcgttatactaggcaagatttgagaaaaatgtcattggtacattatacaatttatgacaataaggaaaatatagttgataaagataaattggtttatgtatcaatgcgagagggaattgtaaaaatatctccacatgaagtgacatcctccaaagaaagagttaatttgttattagggcaaccgatagattcgatatttatatctgttaatgatggggtaagtgtggtcaaaaaaattattgaggtatttaatataaattattactatcctcatccaagagagaggtttattattgatggtgttaattatataaaaagtaaattaatctttgaagattattttgtatcgcagttcagacttaatgtcgaatataccatttatacgttctatagtggagctcctcttagttttattaatttacctaatgtaaaaattattagcattaaaccagatatttgtagaaatgaaattgttcaagattttgagattatgaaatcatttggtgtagaagtaattgactacacatgccaatagagatagctattatggtaatgggattttatatattcttaattatagcaacattgttgctttctatattttctaaatcagaaaataagaaatcttttcgtcaatgctatattttgctttttatcttgttagtatgttggtctatattatgtaggacttatgctattcaacaggatatattggtatatatggaagttatgaaatatggagtagatagctttttttctagtttttattttttgagagaacctgtgtattgggtttctagtggagttttatatagttttattaaaaatgagattttagtactggtattctgcgacattattgcatttactgtacttgtactttcttgctaccatgctaaattaaaaccatattttgttttattgttttttttattttttccttctgtaatgggaatattaaatgtttataggcagtttttagctacgatttttttattttgtttctttttactgtataaaaagaactttcgattttcatttaactttatgttcatattagcatgttttactcataatatggcaggggtatttcttcccctcttattcttgataaaaaaacgtataaatatctttcttcttattattagctctgtggtggctataattgttgcagttatatttcaagatggtaaatcgactcgaggttctggagatgttccatcatttttgtttttagttgtaatttttgttgtattttttatatttgttttattaaataggttctcatttaaagaggaatctttaagatttttttatataaatttatatgtggggatgttagctatttgttcagtattcttcttaagtgatgttgcagccaaaagaattttaatggtaggtatgatattcttattattctccatctattcttcaatagaagagaggataaaagaggaaaaaaatagatttttaattagggtattttttgtgctaattagtatcgcacctacatttttgttttcatcagtattggaaatgttattaatttcttaaattgagaataatattttaagtaatttaattaaatttgccttttatttttttattagttatggagctaaataagagttaataacataactgtatggtttattggtattttataagaaagaaaagatattttaacgctatcaacattcctgatgaattaactgaggaatgaatgtattatttatgataatatataggagagtaaatgaaaattgatttcgtactaccttgggtaaacccactggatagagagtggcaggcaaaaaaaagtttctatagtaatataaatttaaaagaaactagttcaaattctgaatcaagatatagagatatgggaactctaagatatgttctaagatctatagaaaaaaactgcccttggtataatagaatatatttaattactgagggacactttcctgaatggttagatataaataatgaaaaaatatttttaattacacataatcagctttattatgagaaagaacaccttcctatttttaattccagttcaattgaaatgaatttgggtaatatagatgctctatctgaaaattttgtatatttaaatgatgatatgattattatgaggggtgtcaataaagagcgctttttctttcatgataaaccagttgattttttaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgattttttaagtcatggctggttccctagaaataaaatatatttttggcttaggaattcagatgtatgggttaattcattgctcaataacttaaatttagttaatagtcaatgtaatcttgaaaaaatagataaaagtatgctttatcatgagtcgtattcagttaaagataaactctctaattttttattttttaatatatataaaaaggctttttggttggaacattggcatcatcctcaaccatataataagagaactttattgttagttagagaactgttttctaaagaaatgtcaatttgctctgcaaataaatttagggataagtcagacttgactcaatatttgtatcgctattggcatttgttgaatggtgacttctatcctaaaaaacattacgatggtatagaacgaaatttgtcatcaatagaaaagctgttagaaatgatagattctattgagtcgaatcagaatataaaatttgcttgttttaatgattccccttatcttagtgatgaaaattataatgaggtcaaaggtgccctgatggattatctgaataaaaaatttccaactaaggcaagttttgagttataaatttggaggtgtttttgatgaaattgtctgtcttaatggctgtataccataaagataaagcggagtatttctctaaggcaatagaaagtatttcgacaaagcaaaccttgaaaccagatgaaattattttggttaaagacggggaggtaccaatagatttagaacaagagatagattattggaaatctatattaggatcacagctaatagttatttcattagacaagaatgttggtacagcaagagctttaaatgaaggattaaaatattgttcaggaacatatattgccaaaatggatagtgacgatatatcttctcctgaacgttttcagtttcaggttgaatatttaaataaaaatcaatctattgatgttgttggtacttggattagtgaaattgatgaaaatgacttcattattaaggatgaagttcgttttcctttaactcatcaagaattatataaattttttgggtttagagatcctttggcaaatcctactgcaatgtttcgacgttcattttttaataaggttgctaaatatagtgatgatgtacatttggcggaggataccctgttatggtttgaagggtttaaaaaccaatgtcagttttctaatatgcctattataggattaaaatttagacgatctaccaaagcattctattttagaagggctaatatgaaaaaaagcatagggttgttaaaatatcgactattcaaaataaatcctgagttggggtatggtatgagagaaaatgtgtatgctgttctttactttttaatggccctttctccaagttatgttaaaaagtttttatataataattttagataatagtttagtgcatagaggtgatatgatgaactttctaccattcgcccttcccgaaattggcgaagaagaaattaatgaagttgttgatgccctacgttcaggttgggttacaacgggtcctaaaacaaaacagtttgaagctgattttgctaaatatataggtgatggtgttgaagcattagcagtaaattctgcaacatctggattgcatctcgctctagaggctgttggtgttaaagctggagatgaagttattgtgcctacactcacttttactgcgactgcagaagtggtgagatatttaggtgcccaccctatatttgttgattgtgatccaaatacgcttaatatcgatgttaaattaattgaaaaggcgataacatccaaaacaaaagcaatagttcctgttcattatgctggactagcttgtgatatggataccattttagagattgccaaaaaatacaatttaaaagttgttgaagattcagctcacgcattccctacgttctataaaggaaaattaatcggaactctagacagtgatgtgactgtatttagtttttatgcgaataaaacaatgacgacgggtgaaggggggatgctcgtttctaaaaacaagcaaattattgagcgtagtaagataatgcgtttacacgggattagtcgagatgcatttgatcgttatcaatctaaaacacctgcttggtactatgaagtcattgaacctggattcaaatataatttgcctgatatttgttcggcaattggtttacaacagcttaaaaagattgataagttctgggaaaagagagagttaatggcaaaaaaatatgaggaagccttatctgatttgcctattattttgccacctaaagcagaaaacaactcaaaacatgcgtggcatatttatccaattcgtttgaaggaagattgtggcattactcgtgatgaatttattattaaaatgtcagaaaaaggcattggctgttcagtacactttatcccgttgcataaacagcctgtatggcgagatacctatcatttaagcccggaagatttccctgctgctgaaaaagtatatgcttcaattgtgtcgattcctttatttactgcgatgacggaagaggatcaagaaagagttatcctcgctattcgtgaaatactcgcttaattgggattttgtaatgctaaaaagagtgtttgatattttcttttcaggattagggcttgtcgccctatttcctgtttttgttgttattgctatttggattaaaaaagattctgatggagaggtcttttttaggcaggttcgtgtaggattaaatggacagttatttaaaattcataaatttagaacaatggcggctaataccgaaaaacaaagtagcttaacaattggagatgataaacgtatcactaatgcagggaaagttctaagaaagtataaattagacgagttacctcagttaatagatgtatttattggaaaaatgagtttagtaggccctcgtcctgaaattcctgaatttatgaatctgtattctgagcaagatagaataaaaattttatccgtcaagcctggtattacagatagtgcttctattgaaatggttgatgaaagtgaaattttgggtaaatatgataatcctcgtcaagcctatattgatattattatgccgatgaaagctaaatattatattgattatgttaataatcataatatatggggtgattttgttctcattctaagaacatttttaaaaatagtttcaaggtaaaaggattatcatctaaacttaacttttatttagctactgaagtaaataatagcaagatatttagttataaacatttaggtagaaatattgaagatatttttgagtgttttaatgtttctctaagtaaaattgaaaaatattctgatacggggtattcagatgaaatactctgaagaacttacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgtttaaatagctcgttgagcaaggtgaatcctcagaagagtatgtcgaagtaatggggcatatgcaagtagaaatagatttagaaatgatcaaaacctgaatctgaaatattattttaaatatatagtcttaactgtcttaggaaaaggcagtagagataggatgagataacagtatgttaatgccattaatttattcattgatatatattcctagaatatataaaaaacttattttattatttattgatttttgtgtgtttccatttttaatttggattgcttatgtattgcgtttattggatttaaatgtagattcaatcccaaggttagtgtatggtgaacttttagtttctgctattgcggttgcaagtttgatcgtttgtggtatttatcgttttgtcatacatactttttctgaaacattaatttctagattatttcttgcaacattaattacggtaattgctttgtttgtattgggtaatagcactcaagctgttattcctatgtcaattcctttaatgtttggcttttttatgttctcttgggtgtatttgagccgaggtataattcgtattttggttcagaatgtacttcaagcgggtgttcctcgtaaacgaattgcaatttatggtgcgggtgctgcaggacagcagttggcagtattgctatttcgttcccatgattatttgcctgtattttttattgatgataatgaaaaccttgccaatactcgtgttgagagtttaaaagtgttttcggctcggaatgtgtttgacaaatttcgagattatcaaattgagcaagttattattgcattaccttctgttgagagatcaagaaaaaatgaaattgtaaaatttttatctggttcaaaagtaaaaattatggagattccgagactgacgcgaattgtcgaagggagtgtttctatcaatgatgttaaagaggttaatatcattgatttgttaggtagagaacccgttgaacctattccagagttattctgtaagaatattcaacatcagattgtgatggtgactggtgctgctggttctatcggttctgagctttgtcggcagattattcgcaatcagcctcgtaaattacttttatttgagatttcggaatatggattatattcaattgaaagggaattaaacaaactggttaaaactcagcagttaggccatattgaaattattccgctcttagggagcgttcggaactttaagcatttagttgaaattatgcgggtttatcaagtggatacggtatatcacgcggcagcttataaacacgttccaatggttgagtacaatatggttgaaggtgtgcggaataatatttttggtacttactatactgctcgtgctgcgattgaagctcaggtcaaatcttttgtactgatttcaactgataaagcagtgcgtcctactaatgtgatgggggcaacaaaacgtagtgccgagttgtgtttacaagcgttggcaatggaaaaaggaaattgtttagatggcattgaacatcaaacacttttctcaatggttcgttttggtaatgtgttaggttcatctggctctgtgattcctttatttaaggaacagatactgaagggggggccagtaactgtgactgatccaaatgttattcgttatttcatgaccattcctgaagctgctcaattggtcattcaagctggagcgatggcgaaaggtggcgatgtatttattttggatatgggggagcctgttaagattgttgatttggcgataaatctaattcaattatcaggcttagtagtgaaaaatcaggataatccaaacggcgatattgagattttgtttactgggcttagacctggtgagaaactctatgaagagttattaattgctggagataatgttgaaacaacagctcatcatcggattatgacagcaaaagaagattttctgccgttaaatgagttactaagtttacttagtaaattagaattggcttgtcagcataatgaatgcgataaaattcgtgatattttgttgaattttccaattgggtatactccggtaagtaaaatagtggattttgtttggcggatgcaagtagataaatagtatatttagattagcctattcctttttgatatattcagtgagaataagaattgggtagtagaatgcatagtagaatagtgaagatttattactcctcaacatgtgtgagtcaaatcaatatttctttttggggtttttctgtgcaaataaatgtggtttgttgtatactaggacggtttttatcaagttcaattcgacgtttggtgtgtgagttttggactattctgatggattttgttaattataaaatgagtaagatggattatgtgtaagttaactaaagctcttgtttttactggtgtgattttatctctttctgggtgtgggatgattttccctgcaacgcattctcctattgttgatacggaagtgaggggagagaatgtggactttaagaaggttgtggatgcttatttaattacgcctcagttagtaaagcaattagctcctcgtacggtgaaagcaagtgataacattggtttagaacaacaaattaagcgttatcaatataagataggtgttggcgacatattaaatgtcacagtttgggagcatcctgaattgacaactcctgcgggtgcttatcgttctgccgctgaatcaggtaatcaagtgcatgctaatggaactattttttatccatatgttgggcagcttaatgttgttggcttaacagtaaatcaagttcgtgataaattggcaaaagctctttcagcctatgtcacagatcctcaaattgaggtaacaattgcctcataccaatctaaaaaagcatatataacaggcgaaatcaagaatccaggacagcaatttttaactaatattccgctcaccttgttagatgctgtaaataaggctggaggattgtctgataatgcggattggcataatgtgactattactcgtcatggtaaagaggagaaagtctctttagcagaattgattcaatttggtaatttaacgcagaatcgtttgttatctgatggcgatgtggttcatattccacgcaatgatgcgaataaggtgtttattgtgggggaagtgtcaaaacctcagatgttgaaaattactcattatggtatgacgttaaccgaagcaattgctcagagtgggggaattgataaattatctgcagatgcaacgggtatttttgttattcgtggtcaacgtgatgtaaataagtcaacggtttcaaatgaagctgaaaaaacagataagattgcagatatttatcaattggatttgactaatgcaacttcctatgtattaggaacagagttttatttaaaaccttatgacattgtttatgtgacaacagcgccagcaactcgttggaatagagtgattgcccatgttgttccgtcattatctggtttcaataatctaacagagtctatcttaagagtgaggaattggtaattaatgtttggaagtattttagttgtttgtatcggtaatatatgccgctcccccgtcggagaaaaattattaaaacaatattttcctgaaaagcgtattttttcagcaggtatttcagctgagcgtagccatttagttggaaaaggtgtagatccaacaatgcaacaagttgctatttctcgtggagtggatctttctgaacatcgttcacagcaattaacgtctgaactatgtaagaatgtagacttgattcttgtcatggaaaaaggtcatattgacttggttcgacaaatttcaccagaaagttctggaaaagtcatgttatttggtcattggttggatagcaataaagatattccagatccttatcgtcaaagtgaagatatgttccgagaggtttatgcattgattgaggatgcagcattgagatggaaattgaaactctaattttaaggcagttaaaagatgaatgaaaataatcatgatgaaattgatttagtaaagttgttgggggctttattagattataagtggtggatagctctttttacattgttggtgacgttatttagtgttgcttatgttttactagctccgcctgtttacactgcgaatgcttcaattcaaatagaaagtaaatcttcaagggggcttttaaacgatttcccaggagttttagagggtgaaccatcttcaagtactgaaattgcaattttaaaatcaagaatggttttatctaatactgttgagcaacttaatttaactacggtagttgaacctcaattctcgatcccttttcttagtaaaggtcttcatcgtttgatgggatatgaaccacaattgtcgctctctttatttgagcctaagaatcctcagatgaaagagatgattttggaggttggggagaatgctggagagttctcattatttttcgcagatgaaaaagttcttgaagggagcattgggaaaaagtatcaaacggaagatttttcgtttgcgatttctgaattagaggctaagccaggacaattatttaaaattaaaaagaatgatgtgttgttagcaattaactctttacaaaaacaaatttcggtaacagagaatggtaagcagacaggcattattgaaatttctattaatggagagaataaagctcaaattaagaagatagtaaagagtgtatctgaaaattatttgctgcaaaatattgttcgtgattctgcagaagcgtctaagagtttagagtttttgtctaaacaattaccagaacttaaagctcgtttggcagagtctgagaataatttgaatgaattccgcttaaaaaatgaatcagtagatctcagtctagaagctaaatcagcattagatactatagttcagttagaagcagatttaaatgagttaacattaaaggagagtgaaatttctcagaaattcactcgaaatcaccctgcttatgttgctttgattgataagcgtaaagtattaaatgaggaaaaaattcgtttaaataaacaagtagaacgtttacctaatactcaaaaagaggttattcggttaactcgagatttggaggtaaaccagcaaatttatattcaattgttgaataaaatgcaagagttagaaattgttaaggctagtacggtaggaaatgttcgtattttagatgaggcgcaagttttgcctaatgccgtttcacctagaaaaatgattgtggttgcctcggcatttatgttaggacttatctttgcctcagttactgcgatagcgaaaacgctactgcatagaggtattgagggaacatctgaattagatgtgttaggcttgccaacgtatgctacgattccatattcaaatgaacagcctattttttctaagcataaggttcagcattttaaattattgtcggagtcaacgcctacagatccagcagttgaggctttgcgtagtttgcgtacaagtttgcattttgcaatgttagaagctaaaaataatatattaatgatttctggagcttctccgtctgtgggaaaaagttttatttcaaccaatttggctaatgttcttactaaagctgggcataaagtgttgttaattgatgcagatttaagaaggagttatttgcgtcgattattaggtttagcaaaagaggttggattgagtgatgtgattgcacagcaaattccttttgaacaagtgattcaacattatgataattttgatattattgttaaaggaaaaactccaccaaatccatctgaattactatctaatgctcgttttcaggcactattagaatgggcagcaaaagaatatgatttagtgatagtggatacagcgcctattttggctgttacagatgcagctattattggtaggtatgcgggaacatctttacttgttgggcgttttggtgaaactacacttaaagaagttggattagctaaagaacgttttgaacgtgcaggggtctttattaaaggttttattttgaatggtataaaacgtaaggcttctaatcgttatgattattatcaatatgattacaaatagttgctaactttgtaatcttgacgtaagcggtgggattttaactatggttataaaaatagtttagaatttcgccgcttagtgttttatctaaactttaaaataatgtttatgtgaataagattagcaaattgattaaaaaaaccttttgatttaatttgtgtaaaaatattgactaaattagtagggtatatagaattctttcctaacaatcgagcatttttaaaaagtttgagtatgaaattaacttcacgaggacgttatgctgtaactgcaattttagatattgcgttgcatggcaaagatatgccagtgagtttggcagatatttcagatcgccaagccatttcactttcttatttagagcaactttttgcacaacttcgccgagaaggtcttgtgcatagcgtgagaggtcctggcggtggctaccaattaggaaaatctgttgaagaaatcaatgtgggaatgattattgccgctgtaaatgagagtgttgatgtgtctaaatgtaaaggcaatggaaattgcagtaataacagtcgttgtttaacccattcgctgtgggagcgtttagaaaatcaaatcgaacagtatttacatacgataactttagccgaattagttgaagaaaatagcgatcacgattgtgagacttctcactgccacgatcattaccattaatcttataaaaatctcttagttaggagtaacaatgaaattaccaatttatttggactacgcagcaactacgcccgttgatgagcgtgttgcaaaaaaaatgatggaatatatgacaaaggacggcgtgtttggtaaccctgcatctcgttctcacaaatttggttgggaagcagaagaagcggttgatgtagctcgtaatcaaatcgctgatttaatcggtgcagatgctcgtgaaatcgtatttacttcaggtgcaaccgagtctgacaacctggcaattaaaggtgcagcacatttctaccaaaccaaaggtaaacacatcatcacggttaaaactgaacataaagcggtattagatacgtgccgtcagttagagcgtgaaggttttgaagtcacttatttagagcctgaaacaacaggtttagtggatattgctaaattagaagctgcaattcgtccagacacaattttagtctccgtaatgcaggtgaacaatgagatcggcgttattcaaccaatcgaagagatcggtaaaatctgccgtgcgaaaaaaatcattttccacgtggatgcaacacaatcagtgggtaaaatccctgtggatgttcaagcattaaacgtagatttaatgtctttctcaagccataaactttacgggccaaaaggtatcggcggtttatatgtttgccgtaagcctcgtgtacgtttagaagcgatcattcacggtggtggccacgagcgtggtatgcgttcaggtacattacctgttcaccaaatcgttggtatgggtgaagcatatcgtatcgcaaaagaagaaatggtaactgaaatgccacgcatcaaagcacttcgtgaccgtttatacaacggtttcaaagatatggaagaagtgtatgtgaacggtacaatggaagcaggtaaacgtgttgatagtaacctgaatatcagctttaactttgttgaaggcgagtcaatgatgatgtcattaaaagacattgcggtatcttcaggttctgcttgtacttctgcaagtttagagccatcttacgtacttcgtgcattaggcttaaacgatgaattagcacatagctcaatccgtttctcaatcggtcgttggacaacggaagaagagatcgatcacaccatcgaaatcgtgaaaaaagcagtaacaaaattacgtgaactttcaccactttgggatatgttcaaagaaggtatcgacttaaactcaattgagtggtcgcatcattaatagaaacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttttgcaaaggggggaataattaacacagaggaatttaaaaatggcatacagcgataaagttattgatcactatgaaaacccacgtaacgtaggttcattcgacaaaaaagcatcagatatcggtacaggtatggtgggtgcaccagcctgtggtgacgtaatgcaacttcaaattaaagtaaacgaacaaggtatcattgaagatgcacgtttcaaaacttacggttgtggttcggcgattgcatcaagttcacttattactgaatgggtaaaaggtaaatcattagatgaagctcaagcaatcaaaaacagcgacatcgcagaagagcttgaattaccaccagtaaaagtacactgctcaattcttgcagaagatgcaattaaagcagcgattgcagattacaaagagaaaaacggtaagtaatctctaacaagcggttagtttttgcaaaaaatttgcaaaatctgaccgcttgcgtttaaagcggttgtagggtgggttttaacccaccatctcttttattaatggtgggttaaaacccaccctacaaacgttttagtaaatcaattcattaggagaaaaaatgagtatcaccctaacagaaaccgcggcagatcgtgttcgtaccttccttgaaaaccgtggcaaaggcatcggtttaaggctgggtgtcaaaacatcgggctgttcagggttagcttatgtccttgaatttgttgatgtattaaacgaagatgatcacgtttttgaacaacagggtgttaaaattatcgtcgatgaaaaaagccttgtttacctcagtggcacagaattagattttgtcaaagaaggattaaacgaaggatttaagtacaacaacccaaatgtgaagaatgaatgtggttgtggtgaaagttttaacgtctaagaggttctgatgtcaaatccatttacgctttttgatctgcctgtgcaattccaagtagataatgctcaactgtctgagcgttatttagccttacaaaaatcgcttcaccccgataattttgcggcaagttctgcgacagaacagcgtttagcaatgcagaaatcggcggaaattaatgatgcgttacatattctcaaagatccgattttgcgtgctgaagcgatcatcgctattcatacgggtgaacagcaagatattgagcaaaaaagtaaccgagatatggcgtttttaatgcaacaaatggaatggcgtgaaaccttagaaagcattgaaaccacaaaaaacgaagcggatctcaccgctttcacccaagagattgagcaacagcaaaaagtcattttgcaacaacttgaacaggctctcaatgctcaacaatggacggacgcgctagccattaacgacaaacttcgttttattaaaaaattattggtagaaattgaacgagtagaagagaagttgtttgagttttaattatggcagattcgccataattaaaatatccgattatttgacgagtgaattaacatgtctaacttacagattccaacgagtgcgaatatattattctatacaacacctgatgaatcagtaaaagtgaatgtcttttaccaagatgagactttttggctttctcaaaaaagtatggctgagttgtttggtgttgatgttccggctatttctaaacacttagataatatctatagcacaggggaacttgttcaattttcaaccatttccaaaatgaaaatagttcaacaagaaggtcatcgccaagttactcgtttgacgaatgtttataatttagatgcaattattgctgtcggatatcgtgtaaacagtcgggaagcaacacaatttcgaatttgggcaactcaagttttacgtgaatttattttaaaaggttttgtacttgatgatgagcgtttgaaacaaggtaaacagtttggtttagattattttactaatcttgttgaacgtattcgtgaaattagagcttctgagcgacgattttacgagaagattaccgatatttatgctctagccagtgattatgataaatcttccgcccatacaaaacgctttttttccactgttcaaaataaattacattgggcgattacaggcaaaacagctgcagagttgatttatttatacacaagccgatgcagaagctataaatatgggattaacaacttggaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagggacgccacgcttggcgtccattgaatatagacttttcactcatctaaagaatggacgccaagcgtggcgtccctacatagaaaaataaatatgaaaaccctcgaagaactgaaggataaacaaaaatccgcttggccaattatgcaagattggttcaagcaagcgaataaccattatgaaatcctgccgagagatgtggaaaatgcaggggcagaattggtgggaatgcagttaccgacaagtacgccactgggtgcggtaatttatgaaacgggcggtattttagtcgatcacggctggttacgcattttaggttcgggtaatgagaaactgccacgcggtttgtttgagtggaattttggtaaaacttttgaacaatcgggcgaaagaccgtttcatttactgattgctgatgatgccattggtggttattttgcggtgaacggtggcggattaggcgaaaaagtcggtttagttcattatttccacccgaaaaagcagaagtgggaaagcattgggctaaactattcacaatttatcggctgggcattgactgccgatattgctagtttttaccacagcctgcgtagtgaaaattggcaagctgagattgcagatttaaacggcaatcaagtgataaatttagacacaaaacaaaaacaaccgattgaacgccattatcaagcgacatttgcacctgatgatatggggtatacggtgaattaagtattacacttccctctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaatgatagagagataataaaatgtcattacttcaaattgcagaaccagggcaaacggcagcgccgcaccaacatcgcttggcggtggggattgaccttgggacgacaaattctttagtagcaacggtgcgtagcggacaagctcaggtattacttgatgagaaagagcgtgcgttagtgccgtcggtagtacattatgctgctgagaataaagttgttggtgtggaagcctttgagcaagcagtagctgatccgcaacatacagtgatttctgtaaagcgtttaattggtcgttctttggcagatgttgaacagcgttatccaaatttaccttatcaatttgttgcgacggataacggcttgccgttaattcaaacgctacaaggcaataaaagtccgattgaagtgtctgccgatattttaagtcacttaaatcaatttgcagaaaaacgcttagcaggcgaattggctggcgtggtgattactgtacctgcttattttgatgatgcacaacgtcaaagtaccaaagatgccgctcgtttggcggggcttaatgtattgcgtttattaaatgagccaactgctgcggctattgcttatggtttggacagtggtcaagaaggcgtgattgccgtatatgacttaggtggcggtacttttgatatttcgattttacgcctgagccgtggtgtgtttgaagttttggcaacaggtggcgataccgctttaggtggcgatgatttcgatcatctgttagcgaattggattgcggaacaagcaggtattcagccaaatacagtaagtcagcaacgtgaactacttactcttgccactcaagtgaaaattggcttgtcacaagcggagagttttactgcaaaatttgcaaattggcagggtgaaatcagccgtttgcaatttaatgagctaatccaaccgcttgtaaaacgctcgttaatgacttgtcgtcgagctttgaaagatgctggggtagaagctcaagatgtgcgtgaagtggtgatggttggtggttcaacgagagtgccttttgtgcgtgaacaagtgggcgagtttttcggcaaaacgccattaacctctattgaccccgataaagtggtggcgttgggggcggctattcaagcggatattttagtcggcaataagcctgatgcagaaatgttgttattagatgtggtgccactttcgctagggatcgaaacgatgggcggattagtagaaaaaatcattccacgcaataccactattcctgtggcaaaagcacaagagttcaccacatttaaagatgggcagacagcgatgacggttcacgttgtacaaggtgaacgtgagttagtcgatgattgccgttcacttggacgttttaccttgcgtggtattccaccgatggtcgctggtgcagcacacattcgcgtgacttatcaagtcgatgcggacgggttactgagtgtcaccgcaatggaaaaatcaaccaaagtgcaagcgtctatccaaattaagccgtcttacggtttaacggacgaagaagtcaccgaaatgattaaatcgtcaatgacgaatgcgaagcaagatatggaagcccgtcagctggcggaacagcgtgtggaggcagatcgtgtgattgatagcgttgtcattgcgttgcaagaagatggtgcagagctactttcggttgatgaatttaaagggattgaagcggaattacagaaattgatttacgcaaaacaaggaacagatcgccaagctatccagcaaggtattaaagatcttgatattgccacccaagaatttgccgctagacgaatgaatttatccattcaaaaagccttagcaggtaaggcggttgatgaggtgatgggataaaatccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccgcaaaataaataacggacacacgcagtgtgtccctacaaataaacagaagatattagaggacattatgccaaaaattgtttttcttccacacgaagaattttgcccagagggtatggttgttgaagctcaagcgggtgaaaacttattagaagttgctcacaatgcaggagttgaaattcatcacgcttgtgactgttcttgtgcttgcactacttgtcacgttgtaattcgtgaaggttttgacagcttaaatgaaacatcagatcaagaagaagatatgttagacaaagcgtggggcttagaaatcgacagccgtttgtcttgtcaatgtatcgtgggtgaagaagatctcgttgttgaaattccaaaatataacttaaatcacgcaaatgaggcagcacactaatgaaatggactgatgtaagaatgatcgcagaaaatctgtatgatatgaacccagatttagatccaaccaccgtgcgttttactgatatgcacaaatggatctgcgagatggaagattttgatgatgatccagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttccgatcttgataatggtcgtgtgattcctcgtgactaccttgctcaacaatttcgcctttatctaatacaatcaagcgatccattgccataatggtcgataaacggtgtgcaatggcaacgacagttttcccttccattaattcggtcaaattttcttgaatagcgacttccacttcagagtctaaggcactggttgcttcatctaataataaaatcggtgcgtctttcaacatcacacgagcaatcgcaatacgttgacgttgtccgcctgagagtttcacgcctcgttcgccgacgtgtgcatcatagcctgttctgcctttagcatcactgagaagcggaataaaatcagaggcagaggctcgctcaacctcgtcctgataaaagctcatactttgtccgagtatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaaacgccacaaaatagcttctcattcctttgatgctttcaaaaataaaaggaataaccttcgctcgaggtgtattcggcatatcttctggataaggattaatgcgattttcaaaccaaccaaataatttatttaacacgagctttccttataagtatgatggggagtaaaaattgaaaggtgataaatgtagcggacacactcagtgcgtccctaccatttgaaaagaaactattgttagttccgtagcaataactatggatttagcaatttctcatctaatgctaaatctttgttacggttaataccaatcggttgttttaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgcacaatttcgtgtgcatcagcaagagaatgttccttatatgaaccacattgaaactcatttaactcaggaattttagtttcatcaggcactttctctaacgcatcacgcatagaggcttcccaagcttttgccacttcttcagctgaaggtgaaccaattaacgacatataaaatcccgtacggcaacccatcggggaaatatcaataatttcaacggtatcgctattgagatgatcacgcataaaaccagcaaataaatgttccatcgtatgaataccacgaggtgataaaatctcaatgtttggacggacaaaacgcaaatcaaacacagtaatcgtatctcccttcggggttgtcattgtttttgcaacacgcaccgcaggagcgttcatacgagtgtgatccactttaaagctatctagtaaaggcataacgattctccaataaataaaattatgtggggattatagcctatttaagcctgagttttcatacaagcggtaagttattcgaaataatttgcaaatttttacttcaaacaaaccgcttgctttctagtcagttcaatcaaaattctgtataatcacccgtctttttgtgatcttcatcacaattttggatttcgtcagatgagctttagctcatcatttttattctcggtgggcgagccccaccctacaattaagttatttcaatgcaacaattagatactcaaaaactgcgtaatatcgcaatcattgctcacgttgaccacggtaaaaccacgctggttgataaattattaaaactttcaggcacattagatacctctcgtggtgatgtagatgaacgtgtaatggactccaacgaccttgagaaagagcgtggcattaccattcttgcgaaaaataccgcaattaactggaacggctatcgtatcaatatcgtagataccccaggacacgcagacttcggtggtgaagttgagcgtgtactttcaatggtggactcggtattacttgtggtcgatgcctttgacggtccaatgccacaaacccgtttcgtaacccaaaaagcatttgctcacggtttaaaacctatcgtggttatcaataaagttgaccgcccaggtgctcgccctgactgggtggtggatcaagtattcgacttattcgtgaaccttggtgcgacagacgaacaattagatttcccaattatttatgcttctgcattaaatggtgttgcaggtttggatcacgaagatcttgcaccaaatatggatccgctctttgaagcaattgtagggcaagtttctccgccagatgttgaacttgatgcacctttccaaatgcaaatttcacagttggattacagcaaatatctaggtgttatcggtatcggccgtatcaaacgtggtacggttaaacctaaccaacctgtgaccgtgattgatgcagaaggtaaaacccgtaatggtcgtgttggtcaagtgttaggtcacttaggcttacaacgctatgaagccaccgaagcctatgccggcgacatcattgcgattacaggtttaggcgaattaaacatttcagataccttatgtgacatcaacaatgttgaagcacttccagctttatctgttgatgaaccgacagtgacaatgttcttctgtgtaaacacatcacccttctgcggtcaagaaggtaaattcgttacttcacgccaaattttagagcgtttgaagaaagagttagtgcataacgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgtcgcattacgcgtagaagaaactgatgactctgatgttttcagcgtatcgggtcgtggtgaattgcacttgtctgtattaatcgaaaatatgcgtcgtgaaggttatgaattagcggtatctcgtccaaaagtaattttcaaagagattgatggtcgtaaacaagagccgtttgagcaagtgaccattgatattgaagaacaacatcaaggggcggtgatggaagcgcttggtatccgtaaaggtgaagtgcgtgatatgatcccagatggtaaaggtcgtactcgtttagaatacattattccaagccgtggcttaatcggtttccgtaatgagtttatgacgatgacatcaggtacaggcttactttactcaagtttcagccactatgacgatgtaaaagcaggtgaaattggtcagcgtattaacggcgtattgatttcaaacggcacaggtaaagcccttgcttactcgctctatgcactacaagatcgtggtaaattaatgatcgatcacggtgcagaaatttatgaagggcaagtaattggtattcacagccgttcaaatgacctaaccgtaaacccgcttgaagggaaaaaactcaccaatatgcgtgcgtcaggtaaagatgatgctttaaccttaacaacgccagttaaattcagcttggaacaagcgttagaatttattgatgatgacgagttagtggaagtaacaccaaaatcagtgcgtattcgtaaaaaattactcactgaagtagaacgtaaacgtgcaagtcgtaccacgacaagtaccagcacgaagtaatgagaagtaggggcaacaatgcccctaataatttataggagattaaaaatgtttgtagaaatttacggcagattaagttgcccttattgcgttcgagcaaaacagcttgcagaaaaaatgaaagcagaattacctgatttcgattttaaatttgtcgatatgatcgctgaaggtattgaaaaacaagatttagaaccgcgtgtgggtaaacctgttgcgactgtgccacaaatctttttagatgaggttcacgttggcggttattcggattttgctcctcttatagaagagaagtttggaattaaattataagaagattttaacttacccatttggaattcggttagttaatctgtagcattgcctataataggctactgacatatgagagagctttttaagggattgtatacaaaaatttatataagaattaggttaaagccttattgttataaggctttaactttctaatcaacaaaaattattcattattttagtctattaaaaatcgttatatttagatatgagatcagtttttttatgaatttagaatacttatttcatatgggaacctattatgatgaatagaattatcaatataggagctggtgtaatagacaaaatagcaattaagaaatcattataaatatttagactgtcgggagtaatatcacagggtatgagatcacgtagatcgtgttctttactctccattgctattgtgtttcagtccattaagcgcaaccagccctttatcacaactttttttctgcatgatgagatctaatttgaggatctgttgttttgatgaagagagtttgttcttcattgtctgcatttgagtatgtgtaccaggttgtttttctgcatcagcaatcagtttatcaacttcttgaaacattttttggcactgttcaggtaatatgccattggtttgaggtttggtcattaccagtgaagatgttttcaattcagtagtgaaaccacttatcgcaatgaataatgcaccagttgcgataatcattgaacgtaaaatagcgtttttcatagtgttcctaatgattagtttaactgttagatgaaagtcgcgtatactaacatagatcttgatatatcgtcacgtactatttaaggatctttattctttatgtaaacaaattgttaaactcaaaagttatattcacaaataatttacaaataggttggacagataaatgtgtagtattttgtctaacttgatttatatcaagttataacaatataaatttcatattttttaaatatttagctcaaaaatgtgatcaatgtaataattttgctattttttatttgcttatttacgagtagaatagattcttgacattattgctacttattaatctttgattagtaactgtacgaaaacaatgttgattgggggattacttggtattcttgtaatcgaataattcagacttgtatataaagaggtttgagatgttagacgttgttgaactctcacgtttgcagtttgctttaactgctctctatcacttcttatttgtaccgcttacattaggcctttctttcgttcttgtggtgatggaaaccttatatgtaacaacaggtaaagaagtgtataaggatatgacaaagttctggggtaagttatttggtattaactttgctctaggggtaacgacagggattacaatggaattccaattcggtactaactggtcatattattctcactatgtgggtgatatttttggtgctccattagcgattgaaggcttaatggcgttcttcttagaatctaccttcattggtcttttcttctttggttgggatcgtttatcaaaaggtaaacacttactaacgacttttgcggtcgcatttggttctaacttctctgctttgtggatcttagttgcgaacggttggatgcaaagcccagtaggttcagaatttaactttgaaacaatgcgtatggaaatggtcagcttctctgacttagtgctaaacccagtaacacaatctaaattcttacacactgtttcagcaggctatacctgtggtgcgatcttcgtattaggtgtaagtgcatactatatcttaaaaggtcgtgatcttggatttgctcgtcgttcattctcagtaggtgcaagtttcggtttagtggctattatttctgtattaattatgggtgatgagtctggctatgaaatcggtaaagcacagcctgtgaaattagcggcaatggaaggtgaatttgaaactcacccagctccagcagcgtggaatgcgtttgttattcctaatactgcagagatgaaaaatgaagttgctatcgcagtgccttatgcagcagggattatcgctactcgttctttagatacagaaattaaaggtttgaaagatcttcgtgaagagaacgtacagcgtgtacgcaatggtatcgttgcttacggtttattagaaaaattacgttcaggcaactatactgtggaagataaagaagcgttcaaagcagttcaaaaagatcttggctttggtttacttttaaaaccatatacagacaaagttgttgatgcaacagaagagcaaatcttaaaagcagcagcggatactattccaaacgtaggtccaacattctggtcattccgtattatgatgattgccggtggtttaatgttattacttattatcgcagcatttgttcaaaatgtacgcggtacagtaggtactaaaccattgttattaaaagcattgttatggggtattccacttccttggattgcgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttagctgagtatggtcgtcagccttgggcagtgtacgaagtattgccaacaggggttgcgaactctgcattaacagcggcagatctttggatctcaatcggcttgctatgtggtttatataccgtattcttggtagttgaaatgtatttaatgttcaaatatggtcgtcttggcccaagtgcattaaaaacaggtcgttaccactttgaacaatctgcgaaataagtaggagtaaaatatgttagattatgaagttctacgctttatttggtggattttaattggtgtacttttaatcggctttgcgattaccgatggtttcgatatgggagtattaaccctattaccaatggtaggtaaaagcaatgttgaacgccgtgtaatgattaactcaatcgctccgcactgggacggtaaccaagtttggttattaactgcaggtggtgcgatctttgcagcgtggccaacagtttatgcagcatcattctctggctttttcttagctatgatcttggttttagctgcgttattcttccgtccagtaggttttgaataccgtgcgaaaattgatgatcaaaaatggcgtaatgcttgggactggggattatttgtgggcggtttcgttccatcattaatctttggtgttgcattcggtaacttattacaaggcgtaccattccactttaatgagttaaaccaagtaacttacgaaggttcaaccctttggaaattattaggcttattaaatccatttgcattactttgcggtgtggtaagtttaatgatgctcaccactcaaggtgcaacttggttacaaatgaaaacaactggcgaattgcgtaaccgtgtaagaaatgtggctcaagtgaccgctttagtggcgttaggtgcattcttacttgctggtgtttgggtttacttcaaagatggatttgtggtaactagcgttttagatcacaatgcacaatctactttagtgaacaaaacagtcgtattagaaagcggtgcgtggttcaaaaactactttgaaatgccagtattattcatcattcctggattagcagtaatcggtgcattaggtacagtggttggctctaaagcaaataacggtggacttgcattcttatgttcatcaattatgcaagcgggcgtgatcttaacggcaggtgttgcaatgttcccattcgtaatgccgtcaattactcacccagaaatgagtttaacaatgtgggatgcaactgcaagccataacacattaatgattatgtttgtggtagcttgtatcttcgttccaatcgtattagcttatactgtgtggacttacttcaaaatgtttggtcgtcttgacgctaaatatattgaagagaaaagtgcaagtttatactaaggagaaccaatatgttttatgtaacttgggtactaggtgtgttacttgctattctgtttgcaacagtaatcactgtaagtattgaaaaaacaggtaagtttgacgagtaagatggttaattcactctatcaactcacaagaaagggctggctacaagccctttcttttatcctttctattgcaatgtttgcaatgatattgctctattccaacacctttgctctctactttggtggaaaaattccttatttagtagcaggcgttttctatggtatgttgattttattggttcacggttttggctttgagattaaatcaacacgatggcaaatggtttttatgccgttgttgggatatgccattatcttaccttcattaattgcattagtcgtgctgcattagcctttaaattaagaacccaaagcaatgggttcttatcatattgcttgttttatatttaatttatctctaaaaatacttgcacaacgatttttctctctctaaaatggcgagtaatttacgcctgatttttgggcgtttttcgttttggaaagatagatagggcattgcaatggattttcctattcgtgtgtattatgaagatactgatgctggtggtgtagtctatcacgcatgttatttacatttttttgaacgtgcaagaacagaatttttacgtcagttagggttttctcaacagctattactaagtcaatcaatagcttttgttgtgaagaaaatggagattgactataagaaacctgcttatttagacgattttctcacagttaaaagcattatttctgaactaaagggtgccaaaatagtctttaaacagacgttatggcgaggtgaagagcgcttgtgtgaagtgagtgtggttgttgtgagtgttgatctgtcaaaaatgaaagcgatcgccatacctgaagatattaagcaggcttttaacgctataatctcaatgtaattgttttatttggagtttttatcaatggcaactgaatttaatttagtttcattatttatggaagcgagtattgttgttaagttagttatcttaatactgatctctttttccgtgttatcttgggcagtgattattcaacgtagccgcgtattaacaagagctaaaaaagattctttagcctttgaagatcgtttttggtctggcgaagatttacatcgtttacacgaagggttagaacatcgtcgagatggtctaactggtgctgaacacattttctacgttggttttaaagaatttaaccgcttacagcaagcaaacccagattcgccagagtcaattattcaaggttctagccgtgcaatgaatcttgcattaaaccgtgaattagaagaacttgaaaattacattccgttcttaggtactgttggttcgatcagcccatatattggtttatttggaacagtttgggggattatgcactcatttatgggactaagtgcggtaaaacaagcaaccttacaatctgttgcaccaggtattgccgaagcattaattgccacagcgattggtttatttgcagcaattcctgcagtaatggcatataaccgtttgaacttgcgtgtaggcaaattagagcagaattatgtgaactttattgatgagttcaccacaattctacatcgccaagcgtttgcgaaaaaataagtaaaaattaagtgaaatgctaccgcttgttgcggtagtttgaatggatagataaagaggaaactatgtcttaccgtcgtcgtaaacgtaatgacattaaatctgaaattaacatagtgccatttttggacgtgttactggtgttattgctgatttttatggcaacagcaccgattattagtcaaagtgttgaagtggaattgcctgaagatcgccatagtcaatccgtttcaaatgaagataaaaccccagttattttagagatcgctggggtcgctttgtacaaattgaaaattgacggaaactacattcaagttaatgaacaagagaacttagcggagcaagaagtcattgcttatgctggtgaggctttccaaaaggacaataataccttattccttgtggcaggtaaagacgtaccttacgaagaggtaatgaaaggtatctcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggcttattaatactgggttcttttttcactaatactcacttagcttctgctggcggaagtggcggtgatagtgaatctcttgaagctgtgatggttgatactggacaggtagccgctgaatatgggcgattaaaagctgaaaagcaagggcaagcgaaggttgaacctaaagaagagcctaaagaggaagttaaggaagaggttgaagataaacctaccccagaagaaattgctgaacaacaagaacgtgagaaggcaattcagttagctcagcagaagcaacaagaagaaaaacgtcagcaagaattggctcgtcaagaagcattgaaacaagagcaaattaagcaagaacagttgaaaaaacagcaggaagaagcaacacaacgtaaacttgcagaagctgctcgtttgaaagctgaagccgaagcaaaacgtttagaagcccttgcaaagcaagcggaagaagaacggaaaataaaagaagcagagcaacaaaaacgacttgaagagcagaaaaagctaaaagcagaacagcaagctaaagcacaagcagaaaaagaagcaaaagagaaagcagaacaagaagcgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagcagagaaagaagcgaagctcaaagccgaaaaagaggcgaaagaaaaagccgagaaagaagctaaggcaaaagcggaaaaagaagcgaaagccaaagtcgctgcagaggcaaaagcgaaagcagaagcggctgcaaaagctgaaaaagcgaaaaataataaagtacttgatgattttttaagtggtggcgaagttggcggtggcacgagcaacggcggtaataaaaatagtgctggctcacaaggctctggcggtacaaaaggtttaggtcagggtgctaatgttgatggcaatgcctatgggcagcgaattaaaaaacttattcagtcaaaataccgtgttgatccgagttttgcaggtaaacaatgtgatgtgaaaattttcctagagcgagatggtactattaccaactatcaagtcgtttcaggggataaagcagtgtgtgatgcggctgtaagtgcaattgtagcaacccgtaaagtgccaccagcaccatcagatgcagtttatcagcaatataagtcaccaacattagattttagtttaaaagttcaatagttcaacctagagggttaagatgaaattagtatctcgtttaacgagtattcttggtgttatcggattatttttttctgttagtgtaaaagctgagtcagatgttagaatttcgattgaccaaggtgtgagtatggctcaaccgatagcggttatcccatttaaagcaatggggggcgtacctgatgatgtcgctcaaattatcgctgatgatttgagaaatagtggcaagtttacaccgcttgatcgtgcgagtttacctgcacaaccaagttcagcggtagaagttaatcctgaacagtggacgaatatcggcattgataatgtggttgttgggcaagtatctgtggtaggtggtggctataacatcgcttatcaattagtggataccctaggaacgtcaggggcagcaggcaatgtgattgtacaaggttcatttaatgttccagcagctcaaatgcgtttaggtgctcatacagtaagcgatcaagtatttgaaaaattaacacagatccgtggtgcatttagaactaaaatcgcttatgtggtacaacgtggagtgtcctcttacgagttgcgtgtatcagattatgatggttttaacgcctttaccatcgtaaaaagtaaagagcctttaatgtcaccagaatggtcaccagatggttcaaaattagcttatgtgacttttgaaaacaaaaaatcacaggttgttgttcacgatattcgttcgggagcaagaaaagtgatcggatctcttagagggcataatggcgcgccttcattctcaccagacggttcaagagtggcgtttgcttctaaccaagatggtgtattaaatatttatgtaacaggggtgggcggtggttcaccaagacaattaaccagtaacgcaggaaataacaccgaaccaagctggtcaccagatggtggttatatcttgtttacatcagaccgtggtggcttaccacaggtttatcaaatgagttcatctggtggcggtgctagcttaattggtggcagcggcagtggtaaaatttcggcagatggcaagaatttaatcatggtttcaggtgatagaattgtaagacgagatcttgtttcgggtagcacagaagcaatcagttctacgtttttagacgaaagtccaagtatttcaccaaatggaacaatggttatttatagctctaccaaaggtgtgagtaaagtgctacaattggtgtccgcagatgggcgtttcaaagctaatttgccgggagcaggtggacaatataaattccctgcttggtcaccttatctgactaaacaataattcttttttggagaaaaaaatgaaaaaactagctaaagttttaatgattgcggcaccagctttcgttttagcagcttgcagcagctcaaatgacaacgcaagtgctaatgcaggtcaaacattcggtggtatgtctgctcaagatttacaaacccgttacaacactgtatattttgatttcgacagctacacagtaaaagctgaagatcaacaacttttagatgcacacgcacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttagttgcatctaaaggcaaagtaactgttgcaggtcacgctgatgagcgtggtactccagagtacaacatcgctttaggtcaacgtcgtgctgacgcagttaaagatgttttagcaactaaaggtgctagcaacgtagcaacagtttcttacggtgaagaaaaaccagcagtattaggtcactcagaagctgattactctaaaaaccgtcgtgcagtgttagagtactaatttttagttttctaaaatgccaaacagtaaagccccgaattttcggggctttatttttatgtgtaaattctatattacttaattattttttaaggattttccgttaaaatgctcacaattttgaataagtaaataagggcaagagatgcaatttattggaaaaattctcggttttattttaggttataagttttttggcggtttttttggcggcttgttaggtctattaattgggcattggggcgataaaaaactgtatgagctaggtagcgtatcttcaactatgtttggcaaagcactaactcgtcagtcactctttatgcagacaacttttgcggtattaggacatatttccaaagcaaaaggacgagtaacggaaaatgatatccagcttgcccgtcagttaatggcgaatatgaaactcgatgcaaataatcaacaacttgctcaaaaagcctttactttaggaaaagaggctaatttcccgttacgccaagttatgcaagagttccgtgaagcctgtggacaacgccgtgatttattgcgtttcttcgtggaagttcaaatgcaagctgcattacaagatggcaatttagatggcaatgagcaacaaattttattcactattgccgaaacgttaggaatgtctcgtttacagtttgagcagatgatagcaatggtggcagcagctcaacgtttccgctcaggctattatcaatatgaacagcaaggctcaaaccaacaaggacaatatcaaggaaattatggtggttatcagcgttcaagtgaaccaagtttaaaagatgcttatagcgtattaggggtgtcagaaagcgacgatcaaacgacggttaaacgtgcctatcgcaaattaatgaatgaacatcacccagataagttagtcgctaaaggtttaccgcctgaaatgatggaagtggcaaaagaaaaagcacagcaaattcaagctgcttatgatcttatttgtaaatcaaaaagttggaaataatgcaaaaaagttctcatatcgttccgcttttcttagcgattgtgattacggttgtttccgtatggtctggttttaacccgacagacagagccgtctggtatgcagaagtaatgccgatttttgtggtatttgctctacttctactcacttatcaacgttttcaatttagtgggcttgcctatgtgctgatgtcactgtggatgattatgcacctcatcggtgcaaaatatacctttgcgaatgtgccgtttgattgggcaaatcagtatttgaccttcttaggcgaagatcgtaaccactttgatcgtgtagatcactacattatcggcttttatagttacccaatggcagaatggttattgcgtaaacgtaaatgcggcttgggcgtggcattcttcttctcgctcttttttattatgtcagttgccgcaacttacgaaatcatcgaatggcaatatgcagtgattgaagggggtaatgctggcattgaatttttaggttcgcaaggcgatatttgggacgcacaaaaagatatgctcgccgatacgctaggggcaattactgcattaatcatctacttaattgctcgccctgatctacgtttacgccattcttcttactaacaagcggtcggattttgtggaaaatttaccaaaagttatccttgcacctatgcaaggggtgttagatccttttgtgcgtcaattattaacgacagtcaatgattatgatctgtgcatttcagaatttgtgagagtggtcgatcaaaaactgccgaagaaaacgttttatcgcctttgccctgaattacataataacggttttacctcatcgggtacgcctgtgcgagtacaacttctagggcaacacccacaatggttagcagaaaacgcagcacttgccgttgaactaggctcgcacggggttgatctcaactgcggttgcccgtctaaaacagtgaatggcagtaatggcggtgcgtccttgctgaaacaacctgagttgatttatcgagcaacaaaagcaatgcgagaagcggtgcctagccatcttcctgtgtcggtcaaagtgcgactaggctgggatagtagcgaacaagcctttgagatcgccgatgcggtggtgcaaggcggtgcaacggaaattaccgtacacggcagaaccaaaatggacggctatcgagcagaacgtattaattggcaagccatcggcgagataaaaaaacggttgcctattcctgtgattgcaaatggcgaaatttgggattatctctctgcaaaaaaatgccgtgaagtgaccgcttgcgatgcgttaatgattgggcgaggggcattaaatgtgccgaatttaagcaaagttgtgaaatataatcagcctaaaatggcgtggagcgacgtattacagctattgtttcaatatgtgcatatggaaaatgaactggatacaggcttttatcacgttgcacgcattaaacagtggctacgttatctcgataaagagtatcccgaagcgctgcaactgtttgatattctcaaaacagaacacggctacgaagggttaaagcaacacattacacaagcggtgagatcttaatggaaaaacgcatttttaccgaagaaatggttgaaacagaagtaaaacatcaaccaaaacaagagtttagcgacgcagacattcagcttgacgaagatccaaaagcagttgaagcagaactgattattgaagaaagtttaaaaccctcttgcttctggctaaggttatttctagctgcgttggctctgtttggcgttgcgaccattgctcaatcagtgcaatggttaattgatacttggcaagcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtggatctactttgcctttgccgttgccttttttggcatcagtttggctggtgtaggggctattatcaacgaatggagaaagttacgttggttgcgtaaacatcattatcatcagcaagtgagccaacaattactactggaaacagcggatacaagcggtgaaaaagcacgagaattttgcaaattggtggttaaaaatttggctcaaacgccgatggttcaacaggcggaacagcgttggcaatctcagcttgacgaagcctataacagccaagaagtgctgtatcttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatgcaattatcgttgccgtaagccctttggcgttggtggatattttaatggtggcgtggcgaaacattgctttagtcaataaaatcaccaaagcctacggtatggaattgggctatatcagccgtttaaaactgttccgaatggtgatgaccaatatggtctttgcaggggcaacggaaattgccagcgatgtcgggttagattttttctcacaaaatctcaccgctcgtttatcggttcgagcggcacaagggattggtatgggactgctcaccgctcgcttaggcattaaggcaatggaattttgtcgtccagtggtgttccaacaaaatgaacgaccaaaactttctgttgtcagacaagagctgatcggcgttctaaaagaacaaatgttcagtaaaagtagggaagaatttgagtttttccacaataattaattttacaatatctgcatgagtttactgatgttgtattctcttcgagggcaaaattgtgtagttgttttaaattaaatactaatctggcataatgcccgaagagcgaattaatccctgaataaaatgatttactggctgtttttgtttggatgtcaatcattaaatgatacggacagcggtataaataatacgatttagctatagtaacttatcaagttactttcttatgaaaaaaaagagttaatcagattaattaaatgttttaggttgtctaatgaaaattgcccttggaattgagtacgatggttgccgttattgtgggtggcagcgccaacaatatgttgattcagtacagcaaagattggaagaagccttatcagtcattgcaaattcatcttgtgaagtgttttgtgcagggcgaactgatgcgggagtacatgctactgggcaggttgtacactttgatacggatgtaaatcgacctatgcagagttggtgtttagggaccaatgctcatttaccagaagatattgtggtgaaatgggctattggagtaagtgacgattttcatgctcgttttagtgctcttgctcgtcgctatcgttatgttatttataataataaattacgttcagccatattaccgaaagggatttctcattatcactattctctggatcatgaaaaaatgcatgaagcagggcagtttttattgggagagaatgatttcagttcatttcgagctgcgaagtgtcaatcacatacgccatggagaaatgttcatcatctcattgtgagtcgccatcaagactatattatattggatattcaagcgaatgccttcgttcaccacatggtaagaaatatagttggtagtttgattgaggttggaagaggcgataaacctgttgaatggattaaatggctattagaaaaacgagataggacgttggctgcaccaacagcgaaagctgagggactatacttggttgaagttatttatcctgagaaatttagtattcctcagatgccattaggacctttattctattatggtaaataactatttatgtatattttaagaaaatcagtactagtatctttgtaaatgattctagggataaatttaagatgaattgtgcagaattattagtcaatgtaaccccaagtgaaacgagggtagcattggttgaaaatggtgtgttaaaagaagtccatattgagcgtgaggcaaagcgaggtgttgtcggtaatatctataaaggacgagtgacacgggttttgcctggtatgcagtcggcatttgttgatattggcttagaaaaagcggcatttttacacgcctcagatattgtttctcatactgaatgtgttgatgaaagcgagaaaaagcaatttgttgtcaaaaatatcagcgagttagtgcgagaagggcaggatattgtggtgcaagtggtcaaagatcctttaggtactaaaggggcaagattgacgacagacattacattgccctctcgttatttggtttttatgccagaaaatagtcacgttggcgtgtcgcaacgcattgaaagtgaagaagaacgtaatcgcttaaaatcgttagttgagccgtattgtgatgagctaggcggttttattgtaagaacggctgctgacagtgtgagcgaagagagccttgaacaagatgcggctttcttaaagcggttatggcgaaaagtactagagcgaaaaggaaaatatcctgcgagatctttactttatggggaattagctttggcacaacgagtgttgcgtgatttcgttggaacgcatattcattcaattcaaattgactcaaaaatgacctatgagcaggtaaaagagttcttagctgagtttatgccagagttagccaagaatgtgagtttatatagtgggactttacccctctttgatgtttatcgcattgaagatggtattcaaaaagccttggataaacgtgttgatctaaaatcaggtgggtatttaatcattgagcagacagaagcaatgaccaccatagatattaacactggggcttttgtcggacaccgaaatcttgcacatacgatttttaatactaacattgaagcaacacaggcaatcgcacatcaattacaactgcgaaatttgggtggtattatcattattgattttattgatatgcaggaagaagagcatcgccagcgtgtgctagagtccttagaacttgctttaaaaggtgatcgagtcaaaacaaatgtcaatggttttacccaacttggtttggttgaaatgacgcgtaaacgtaccagggaaagccttgaacgagtgttatgttgcgattgttcttcgtgtaaagggcgaggtacgataaaaaccgttgaaacagtctgttatgagattgttcgagaggtcgttcgagttcatcatttatacaaatcggaacgttatgtagtatatgcttctcgtagcgtggcggaatacttgattaatgaagaatctcacgcattgcttgcggaattagaagtttttatcggtaaaaaagtcgaaattaaaattgagccgtattatcaccaagatcaatttgacgtagtggtaatgtaatattaggcttgatagcttaaaaaataatctattttgaaataaagttgttgcaaaatacaggggggggcttagaattcccccgtcttttatttgaaagacttggtttttttggagtaatccaacctcttctttattttactcttttaggagaacacattgatgaaaaaatgggctgttgcattcacttcgggtatggtgatgttaggggcaaatagtgcattagcaaatgacactgtacatctttatacttggacagaatatgtgccagaaggtttgttagaagaatttactaaacagacaggtattaaggttgtggtttcaagtcttgaatcaaatgagacaatgtatgcgaaactaaaaattcagggtaaagatggtggttatgatgtaatcgcaccaagtaactacttcgtgtcaaaaatgggacgtgaaggtatgttaatggagcttgatcatagcaaattacctgtgatcaaagatcttaacccagactggttaaataaaccttacgataaaggcaataaatactctttaccacaattattaggtgcaccaggtattgcatttaatactaattcatacaaaggtgataatttcactgcttggggcgatttatggaaacctgagtttaaaggtaaggttcaattacttgatgatgctcgtgaagtattcaacattgctttattaaaattaggtcaagatccaaatactaaagatccagcagtgattaaagcggcttatgaagagttattaaaattacgtccaaacgtattagcatttagctctgataaccctgctaactcatttatttctggtgaagtagaagtgggtcaattatggaacggttctgtacgtattgcgaaaaaagagcaagctcctgtaaatatggtgttcccgaaagaaggtccagtattatgggtggatacgcttgcaattccatctaatgcgaaaaacccagatgcagctcacaagttaattaactacttattgagtgcacctgtggctgagaaattgacattagaaatcggttatccaacttcaaacgtaaaagcgttagaaaaattaccaaaagagattaccgaagatccagcaatttatccaacctctgaagtgttacaaaaaagccagtggcaagatgatgtgggtgatgcgattgagctctatgaaaaatattatcaagagttaaaagctgcgaagtaattccatagacatcgcttaaaaacctcaaggcttaccttgaggttttttgtatgaacttttcttgcaattttcgttctatattgccgtagaaatttatgttaaaattctcagccgtatctaaacgaagaagagattgtatgaatatccgtttaaatattattctagccacattagcagcagtacttgctggttggtattatagtcaacaaagcgatgatactggattatctcagctaataaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaaggaagtgcagagtatatagggcaaaagatttctacaagtgcttatgatttaaatggaaagccgcaatattctgctcaagcagaggaggttaaacgttacgaaagtacgcaacgaacagaatttctaaagccattactaaatttatttgatgcagaaagtgcattaaaacagtggcaagtcgaagccgattatgcagatgttaccaaagacaaaatattgaatttgcgtggaaatattaaaattaatagcttagatccgacttctcggttacagaaaatcgaagcagaagtattaagcatagatttaaatactcaagatattttttcagacagtatggtgaaatcaacaggcattggatttacaagtactggaattggcttaaaaggcaatttgaaaaaacaaacggcaaccttaaccaaagatgtgaaaacttatattgaaccaaaatttattaatgttgataaataattagagttttacatagggatatagaatgaattttagaactaaacttgtattaataattgcattgtgtcttgtaaatctatcggttaaggctttggaaacagatagaaatatgcccatcaaaattgattcaggtagccagtcattggatatagaaagaaatattgtgacatttagcgacaatgttgttattactcaagggtcaattaagcttaatgcagaaaaagttacaatcattagaagggatactcaaaaggaacttattgaggcttttggcacaccggttgtttttcagcagacccttgataatggtaagattgttaatggtacggctaattctgtacattatgatttagattctgaatttttgatattaagaggcaatgccgaattaaagcagctagatagtgccattaaagcagaaaaaattacttatgatgtcaaaaaacagaaccttaaagcgacgagtaatgaccgacaaagagtaaaaactgtattaattccaaaccaattgcaaagtgataagaaataggaattctgtatgccaacattatatgctgaatatttggctaaaagttataaaagtcgccaagttgttaaagatgtaagtttaaatattaaatcaggcgaaatagttggactattaggtcctaatggtgcaggaaaaacgactactttttatatggtagtgggccttgtgcgtcacgatcatggtaaaatccgtattgatgatcaagatatcagtgttttacctatgcatgatagagcaaaacaaggtattggttacttgcctcaagaagcctctatttttcgtcgcttaagtgtttatgataacttgatggcggtgttacaaattaggaaagatctaaccgatgcagagcgtcaagcaagagcagatgaattaatcgcagaatttcatattgagcatattcgtcacagcttagggcaatctttatctggcggtgaacgccgtcgagtagaaattgcacgtgcgttggcagctaatcctaagtttattttgttggatgaaccttttgctggggttgatcctatttcagtgatcgatattaagaagattattgtgaatttaaaggaacgaggattaggtgttttaatcacagatcataatgtaagagaaaccttagatgtttgtgagcgtgcttatattgtgagtaatggtcagatgatagctagtgggattcctcaagaaattttacataatgaggatgtgaaaaaagtttatttaggtgagcaatttaggctgtaatataaaattcttaagatatttttttgtcgtttgattttttatgatgcaattaaccacatttttagacattaataatatttattacaatgttcccatttctaataaaaaacaggctttagagtttctggggaaggcgatggcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcacctacagataaactatgtattcatccagcagaatgttttagctatttctttaaacgtgaaaaattaggttctaccggaattaataatggagtggctttacctcacgcaaaattgttgatgagtcaagaatttcagctagagaaaccaattgctattttcctgaaactagaggcaggaataaattttgaatcaatagatcataaggatgtggatattatttatgccatattcttttcagaaaaaatttgtgtagaatataaggattctttgagagaaatagcacagcaattaagtgataagaatttgttaaagcatctaagagctgcattatccagagaagaaatttggcaagtattgagttattatgattattcggtaaacaaaaatttagaatcgaggaatgtaatgtggaattgattattatgagcgggcgatctggttcaggaaagtctgttgcgttaagagcgttggaagatttagggtattattgtgtggataatattcctcttgctttaattccccagttaacagattatttagaaaaattgaagagatctgttgttgttagccttgatgtgagaaatttaccagaagatccagatgtgcttgagcaagtattacatgcgtttccctctcacatttcaaaaactttaatctttcttgattgtcagcgtaaggctttagtccgtcggtatagtgactctcgtcgtttacatccattatctacccatgatttatctttagaaaatgtgattgatttagaaaatcatcttcttgaaccattatttcagcatgcggattatattattgatacaacgtacttttcttcacatgagttagcagagaaattaagagaattattaaatggatcatcggagaaagaattgaatattattgttgaatcttttggttttaagtatggcattcctgccgatgcagattatgttttcgatgtccgttttttacctaatccccattggaatcttgagctccgtcctatgacaggattagaaaaacctgttatagattttctagaaaatcagtcagaagtccatcaatttatttctcatacttgtaattatttagaagtgtggttgcctttattggagcaaaataataggagttatttaacgattgccataggctgtacaggcggaaagcaccgttctgtatttgttgcagagaaattagccagatatattgaaagtaaaggcaaaaaagtaagagttcgtcactgtagtttagaaaaacattataagacatcgtagaatgaaaacagcagatattaccatcattggtggaggaatggttggcttagctttagcaggattacttgcaaatagtaattgtcaaatcaagattattgataaaacagttccctatttaagtaagtcaatcagtaatagagtaagtgcaattaattttactagccaaagaatgcttgaggaaataggtgcttggtatcatatttctgaaagtgatttatctccttatgaccaaatgtatgtctgggaaaaggatagtttttcaagtctctgttttgacaataaagatcccgtaatcaaagaacttggactagagcagctaggatttattattgataatcagcagattcgttatgctctatggaagcaagtcattcatcagcataatgtagaagtgatattggatgctcctaaatttttaggcattaatgataactgcgcttttttaactctagaaaacggagagatgattacaagtaagttagttataggtgcagatggagctcattcttgggttcgtcaacaagctaaaattccattgattagtagagattatcaacacactgcattagtatgtaatgtgagaacaacagaaatgcatcaacaagtggctcgtcaagttttttcgcctgatagtattttagctttcttacctttaaaagatgaacatctttgttctattgtttggtctttgcctacacttgaggctagtagactagttaatagtgatgaaaaatcttttctcaaacaattgaatattgcttttgataatcaattaggaatatgtgagttacaaagtgaaagggatgtttatcctttgaccgcacgttatgctcgcgattttgcccagcaaaggattgctttgattggtgatgcagctcatacgatccatcctctagcgggtttaggtgttaatttaggttttgcagatgctattctattggcaaaagagctacagaaattactctcctttggaaaagatataggagagtaccgcaatttacgtcaatttgaacgagttagaaagttagaagctataaaggttttagttgcaatggagggcttaaagcaccttttctctggcaataatccatttaaaaaattagttagaggtgttggattatctgcaactaatcaaaatagttttgtaaaaaagctacttattcagcaggcaataagtgtgtaataactggataagaatgatttatatgaatatatttaataaagatttttttagtattatttggatattttgaaataaataagtttattaaaattattaccttagtattatgtatgatgtttttatcttcttgtgataatgtcggaaagcatgagagtaacaatagtacttctttagaaaaaaaacatcaaaagaagatgtgcatacagtggagagttcggcttctattgaagctgtggaagactttaataagttggtattatggaatattaagcaagaacaggtattagcagaattgcaacaaaagctgagcagtcaagataaatctgaaattgaagatggattgaatatctttaaaactagaatatcttctattatacaaaatctagagatgatagaggttaaaaatacggatattcagttattgaaattaaggattaaagaaaatctgattttattaaatgattttattattgaatcagtagaaactatgcaaaacccgactttagaaggacaggaaaaaattaaagaaaagtcggatagattattgttactgaataaagaactacagaaatttgaaagcgatttaaaagagaaatttggtattaaatgaagaatataaatataattttttataatatttcctcttattttcttagatggattgacaattttttattaaataatagaggaaataatgctcaaaatttataacaccttaaaacgtgaaaaagaagaatttaaacctatctaccctgatcacgttggaatgtatgtctgtggtgtcacggtttacgatctctgtcactttgggcacggacggacttttgtttcttttgacgtgatcgcacgttaccttcgctatctcggctataacttacgctatgtgcgtaacattaccgatgtggacgacaaaatcatcaaacgttcgttagaaaataatgaaacttgcgatcagcttgttgatcgtatgatcatcgaaatgcacaaagattttgatgcgttaaatatccttcgccctaatgttgaacctcgtgcaacgcaacatatccctgaaattattgcgattgttgaaaaactcttagcgaaaggtcacgcttatgtagcggaagatggtgacgtgatgttcaatgtcgaatctttccaaaaatacggtgccttatctcgccaaaatcttgaacagcttcaagcaggggcaagggttgaaattaaatcggtcaaacgcaacccgatggatttcgtattatggaaaatgtcgaaagagaacgaaccaagctgggattccccttggggcaaaggtcgtccaggttggcatattgaatgttcagcaatgaacagcaaagagttaggcaaccattttgacattcacggtggcggttctgacttaatgttccctcaccacgaaaatgagatcgcacaatcttgctgcgctcacggtgacgattatgtgaattattggctacacactggaatgcttacgatcaacgaagagaagatgtcaaaatcgcttaataacttcttcaccattcgtgatattttaaacaaatatgattgtgaaagtgttcgttacttcttcttaaccgcacaataccgtagcttgttggattacagcgaagaaaatatcggcttggctcgcaaagcgttagagcgtttatatacggcattgcgtggctgtgactggaatgttgaacttacagaaaacgatcagtatgtgaccgctttcaaagaatctatggacgatgattttaatacccctggagcactcgcggtgttatttgaattagctcgtgaagtcaataaactcaaagcagaaaatcaggtggaagcgaacaaacttgcagctcgtctgaaacaacttgcaggcgtgctaggtttgttagagcaagatccagaaaccttcttacaaggcgatgccaataatgatgaagtggcagaaatcgaagccttaattaaacaacgtaacgaagcgagagccagcaaaaactgggcggtagccgatgaggcacgcaataagctcaccgcaatgggcattgtgcttgaagatggtgcaaatggtacaacgtggcgtagggcttaattgattaacaagcggtgggatttgacgaaaattttgcaaatccgaccgctttataaattaaatgtattatttaccccatacctcttcagcgatgtctcggataaattttaatttattccactgttgctcttctgttagaatgttaccttcttcagttggtgcaaagccacattgtggactaagacagagttggttaatgtctatgtattgcgtagcctctttaatgcgctcaataatctcatttctatcttctaatgtgccatctttagatgtaataagcccaagtgcaacttgctgatttttaataaagcgtaacggtttaaaatcccctgaacgatcgctatcgtactctaagaaaaagccatcaacatgacagcttccaaatagtgtttcggcaatcggttcatatcctccggaggagaaccatgtggaacgaaaattccctcgacaaatatgcatagtaattgtcatgtcagcaggtttttctgaaatggcgcgattgactaaataaacatagtcttttgcgagttgttctaaatcgaaccctcgagcttgataagcagctcgcttctcttctgaacaaagctctccccaacttgtatcatctaattgtaaattacggcaacctaatgcatagaatttttctattgcctatttataagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagcaatatcatctaatagctggctattattatttttgttgctcaactaattttgtaatttcagcatcttcaatttgagtcagttcactacaagataaattgccacattggcattgttggcgagcatgttttaagctttcaggacgtagaaaacttcccacaatatcaaaacgataaggggcttgggtacgaggttgtgcattgggaaagagtttagacataatatttccttatttttagtgtagatatgaaaggattctatcaactgtggatcaaaatagtaagtaaatgatgtaaacgatttatttttagaaagacttatataagggagcttaatattttaagctccctaatagattaaggcttcagacttacgccataaaatgcggtatagccaaacggattttgaacaaagccttgtacccgtttatttaacggtacgtagttaatggagtgggcaaacggaatgatcgggctgttttgttggaaaatttcgactgcctgttgatatagttttgcacgtgtttgtgtgtcttgaatttgtaccgctgaggcgagtagcgcctcaaatttttcatctgtccagcgagagtaattggtgccggggatatttgcttggctaaataaagggaataggaaattatcaggatcaccgttacgacttgtccaaccataagtacctgcggcaaattcgccttcacgggtgcgtttattaaaatccgcccattcatgtgtgactagttttgctttcacgccaattttagcccagtctgcttgaataatttcagccgtgcggcgagggttcggattggatggacgaaccacaggttgcacccaaatttccgtttcaaaaccgtttggatagccggcttctgccaataatgcttttgctttttccaagttaaattcatattgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaatgtccgagatattcggaaaatcaatcacatcacactcgccggcttttaacttggcataacgtgttccggcatcaggggtaatgctaaaaattaaacgttcaatgtctgctttgcctttccaataatctacgttagcagtgtaacgtaccgcgtggtcggtctgataagtttggaaaataaaaggccccgttccaatcggttgttgatcaagagtttcgggcttaccctgggcaagaagctgatcggcatattcttttgaataaatagataaaaagtccatggcaaccgtggtaataaacggcgtattcggtttattcagcgtaattttaacggtgtagtcatccactttttcaacggattttaagatactcggtaagttcatccagttaaagtagaagtaggttcctgccgaaacattatgataaggatgatttttgtccgcttggcgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggaatgagaacaccacatcatcggcatttaacgggcgggttgggctaaaggttttgttgctgtggaatttcacattttggcgtagataaaatgtatagaccaaaccgtcttcactgatttcccaacgttcggctagacccggctctacttcaattttaccggctttgaattcgactaagcggttatagacttgttgtgagctggcattgaagtcattagcatcatttgtaattgccggactaagtttcatcggtgctgtcgcaatacagttgaccaatgtatttgtcggtgccgaaatcgcggcacatgaagcagaaagaaaacccaagccgagaaagagttttgaatattgcataataagttccctaagttgaaaattccagctcaatctaccgtttttagtgaaaaaattaaaataactgaaggctctaacttataaccaaaatgatatacatacatcggtaacattcctcttatagagaacttacgctaaaatatgtcttgagtggcttatgtttgagtgtgtttatgattagtgtctttgatatgtttaaagtgggaattgggccttcaagttcccacaccgttggtccgatgaaagcgggtaaagaatttattgatcatttaattgattgcaaaaaattggcagaaactgaccgcttgcaagtcgatgtttattgtattgaacgcaatgcgattgcttcggtaaaagcaatcaatgcaagccaaatggcattacgccgaacgacacaaccaagcgtaaccctagataaagtgatcgaaacgatgtatgaaacagggaaagatatgaatgcgaaataccgcgaaacttcaacaggtggattagcaattaagatcttgccttgtgaatgatagatagtatctagtgaatgtgtaaacactaaaggtaaaagttgaattaagtaatttgattttgaagattagcagagcttactcacccattctttcaactcatctttcggcagttttttcaatttcgggcaattgccacagtaatcatttttgctatccaagtgggcgtggcaacagacttttcgtaagcggacgggctgtggaaaaggcaattcggggaaggaaatatattcaacggcgttataaaaaggcgaccattcgtattctgtccatttcttttcaagcagaatttgacggtaggtttcactcacatcaatgccttccgattccaactctttcaagctaaattcaatcaagttggcacagttatgccaaaataccgcttcatttaagcggttaaaaatcggtgaaagaaattgttttaactgttggtaagcgtggagaatatcggtttgattacgtacctgtcgcactggcgtgtagcttaagttgataaaaaatcctttgatcttaccgcttgttgttagatccaaggctgtaccttgctcgctcaacacaagatgtaactggtgtttatgtaacaaccaaacccaatgcataataaaaccattaagccaatagcgttgccagattgaaatagtagctttttggggttcggctaacagtgctgaaaaagtctttggcagtgcagaatgataaaattgttggaaaaacattgcattagagatcttttcaggcttttccacaaaagtaagcaaattacggcaatgttttaggcgttctgaaaataagttttgacgaagtgcattaagctctacacaattaaaaagtatattcataaaaagataaataagtaaatctattttataaatttacatttcactcggatttttatgtttgtggttaaacaggcaagttttgccattccaaatcgtacgttgttacagccgatttcggtgcaatttgaacaaggaaaagtgtatggattgatcgggcataacggttcgggcaaatccacgttaatcaaattacttgccaaacagcaactgctttcatcgggtgaaattctttttgataaccaaccgcttgacgcttggtcaaaccgtgagtttgccaaacgtgtcgcttatcttccgcaacatcttccccaagccactaacctaaccgccaaagagctgatcgcgatgtaggcacgccaacaacagcatttttcccaccatataagttaatcaaagcctataatatttctccacgaactaactacggagaacacgacggtaactatgtaagtaataaacaatatgctattggatatgaatttactcataaatttaccgatgacttaactttctcacaaaactaccgctttgccaaaacagataaagagcaatttgtaacctattactacggcatggaatgggatcctacaacaggtggcgcaagtaatactatggctaaaaaaaggcttcctatttgctgatggtaaaacatattcccatactattgacacccgtttaagcaaagaatggaaatcagataatatttcaaataccctaactggtggttttgattatcaacacagcaaggttgatggggtatatgatttcccttggcctgctacaagctatcatattactcaacttgttaccgctccagttaccttgactgatgttccagtttataaagataaacaacgccagctaggcttgtacttgcaaaatcaattacgtttaaacgaaaaattaactgtaactggtggcgtaagacgtgattttgttaaaggtcacagcgatattcgaggaacaaaatcagaaaataaagttaatcatactacctattcagcgggtttaatgtatatgacagatttagggttagcaccttattttagctattctgaatcttttaggcctctttcaggtagtttagataatgctacaaacggttcatcaatttataagccttatgaaggtaagcaatatgaagttggctttaaatatttgccatcatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaatgggcagatttctgtggcttattttgacttaaaagagaaaaatgctcttgtcgcggctcgtagtggggatgtcaccacaatggctcaggttgaaaagcaaaaaaatcgtggtgtagaaattcaagctgatttaaatattactgaatcgttatctacttctttagcttatagctatatatttgctcaatcccatcgcttagataaacctcgtattgatactccattacaaccaaaccatacttattctgcattagttaattatgcatttaaggataatgtacttaacggcttaacattaggggttgcgcctcgttatactggaacaactccaacagaaatggatggctacaataatgccaatattcgcgttccagcaagaacactagtggatctgatggcgaaatatagcctttcagagaattgggagacaagagtaaacgtaacgaatgttgcgaataaaaaatatatcagtggttgtagttacgcttgcttctttggcgaaggacgtaaagtcactgcgaatttaacctataaattctaataatatctaaattaattggtgcgagtgtctagctcgcaccagtatttacagtgtaatagagaacatagtagctaagaataccaaaaatcatttttagctaccatatctctatttcttccaaatccgtgtctgataatcacgaattgagcggtcagagctgaatgtacccaaacgagccgtattaagaatcgcagattcaacccaagcggtttgatcttgataacgttttgcgacttctttttgagcttcacggtagcttgcaaaatctgctaacacacagaaataatctttgtttaacagatcataaactaacggttcaaaggtatctttattaccacctgagaatgtgccgtccgctaatgcgtcaatcgcttgttttaatacaggatcttgctcatagtacgttttagacacataaccttttgcacgcaattcacgcacagattcaacggtatgtccaaaaataacaacattttcttccccagcaaattctgcaatttctacgtttgcaccatctaatgtaccaagcgtaattgcaccattgagagctaatttcatattgcccgtgcctgacgcttctttacccgcaagagaaatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcaaggcttacacggtagtctggtaagaatgctacttgtaatttaccttgcatatcaggatcgttgttaatcacttttgccacagcgttgatggcttgaataatttgtttcgccataaagtaacctggtgccgctttacctgcaaagataaacaggcgtggtacaacctcttgttgtgggttcgctttaagctcttgataagtggcgatgatattcaacaggttcaaatgttggcgtttgtattcgtggaaacgtttaatttgaacatcgaaaatcgcattgcaattcacttttaaaccaagtgattgctcaatttctttcgctaatagctgcttgttttgctgtttgatgtgattgtaatctgcttggaactgtggatctttggcaaatttctcaatttgagccaacaattcaagatctttcgtccagtcacctttgatatatttatctaacaacgcacttagtaatgggtttgcttggcggatccaacgacgaggggtaataccgttagttacattatggaagcgacctttaaacaagcggttataagctgggaataaatcgcttaccactaaatccgagtgaatttgtgccacaccattgacagcaaaagatcctacaacacaaaggtttgccatacgcacacggtggttcattaagaccgctgtttcgtcccacgcatctgcaaattctgcttcgctaaattccgctttcacttgttgataaagctcgtggttaatgcggtcaatgatgattaaatggcgtggcaacaatttcgcgacgagattttgatcccactgctccaacgcttcaggcaataaagtatggttggtgtaagcaaatgtttttgaacaaattgcccaagctcgatcccaacataaaccgtattcgtcaatcaaaagacgcattaattcggggattgcaatcgcagggtgcgtatcgtttaactggatcacttcaaattcaggcaactgctctaaggttcttccttgtgcaaggtgattttttagaatatcggcaacagagcaagcacagtggaaatattgttgcattaaacgcaactctttaccttcttgatgattgtcgtttggatatagcactttggttaattttgacgcatcaaccactttgctttcagactcaagatagtcgccgtcgttaaattgagcaagatcgaaggacgtttcgctataaccttgccataaacgtaacggctgttgaacccctttataacccactacgggtaaatcaaaggcttcaccataaattgtccacgctggtttccattcatatttatcaccgtcacgatgccatacttcgccaccaaagccaacggtttgacgaaaatctgggcgatgatattgttgagtatagaaatcacggctccacgcatcgccttcttcacgctgttcacctgcccagccaaagctctgtttgaataagccgtattgatagtgtaatccgtatcccactgctggctgagcaaggcttgccattgaatctaaataacaggcagctaaacgacctaaaccgccattgcctaatgatggatcacgctcttcttcgagaatatcgactaaatttttaccatattgagcaagggctaaatggacatattgataaacgctcagactcattaagttgttacccagtaaacgtccgattaagaactccattgagagatagtttactttgcgagtgtttacaagcggtgcgtttttaggaaaattttgcaaaatcgcctgttggctgacttcggcaatgaattgataccattgttgtgtagaaagttgttcaggttttaaaaaacgctcttcacagtagtttttcaacgactgttcaaacagcgtttggaattgttgagtagatgacatgaagactccaaataaaaattttcaaatagtatagagattatgaataaaattgcgagagttaaatcattcttttagaaatgaatggggggggacatcatagtatgacatgtttagaaaggataaatgggatagatttttctctatcccatttaagataatttaaacatcttttgttttttctccagatttatcatcttgttcgggatcaaattttacaacgggtacacagcctcgacaagcaccttggtcaacgccaagatctttacataactcgttgtatttctctaataatgtacgaaaaaaagatttagattcgctactcatatttcacctaacgaaataatgttctgtatgaagaagtgtgcttgaattgacttataataataacagcaaaaacgacaatataaatagagaaaaccacaatcaaccattgtggcatagagagatctaaaaattgccagaccacttttccacaatcgcctttacctgtagcttcaaagagatcagggaaccacttattcaatggcaatgtttcagggaaatccacaaaaggtgagcattggttccacggagcaggattgagctgataatccgtatgcttaattgcaaggcttaaaccttttattgagccaaataaaccaagcaataatgcaagccaacgtacgagcgttttgcggggggctaaaaagccgataatccccgcaattaaaatcgccaatagagctaatcgttcataaatacacatcacgcaagggtttagtcccattccgtgttgaaaatagagcgcagcagcttctagtgctgtacagcttgcagtgagaagtagccaagcactacgacttattgatagctctttaaaataagttagcatacggtttcctttattcttaacgagtgattaaccagccccactccgtcattaattttgttaattgtggcagtaaaaattctaatgcgaagaaccctactcctgataaaactacggtatatggtaatgccatatagaccattcgtccataggataaacgaattaatggtgcaatagcagaagtcaataagaataaaaatgcagcttgtccatttggagtagcaactgatggtaaattggttcctgtgttaattgcgacagcaatcaggtcaaattgttccctactaataatgccagcttggaaagccgcttttgcttcgttaatgtaaacggttccaacgaaaacgttatccgaaatcattgaaagcaatccattaaatgtatagaacagcaccaattgtgagcttggttcagcggacagaacaaattgaataattggatcaaagagtttcaaatctacaatcacggcaacgatagagaagaaagccacaagcaatgcggtaaatggtagcgactcttggaaagaacgtcctaaggcgtgttcatcagtgataccacagaaagctgtacagaaaataataacagagagaccgattaatcctacttccgctaaatgcaatgccaacgcaatgactaaccaaacaccagctatggcttgaataaccaatttcattcggtctcgttttgtcatctcttgttctttacgcaagttataatgggctaataccacccaaactttacgcggcaagcggtcaccataaccaaaaagtttgtatttttctacgagataacaggttgcaatacctgatacaagcacaatgatactaattggagctacccgtaagaaaaattccccaaatccccaatcagcttgagcagcaataattaaattttgcggttcaccgaccattgtcatcacgccacctaacgcactacctactccagcgtgcattaataagctacgcaagaaaccacgaaattgttctaaaatttgtttgtttgtaattaatttatcatttgaagcatcatcggactcatcatcgtccaaaagcccacctgatgcgaccttatggtaaactttatagaatcccattccaacactaataatcaccgcaattaccgttaaagcatcgaggaatgcagataagaatgccgcacttaaacagaaagtgagtgcaagcatttttttagaatggatggaaatcagtagcttagtgaatgcataaagtaacaagcgtttcataaagtaaatacctgccaccataaagatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacttcaaagttggcgagaatttcttttttgatatgctcagcactcgtcattccaatagcgacagcttcaatggcaagtagaccacctggttgtagaggataacattttaatgccattgctaacgtaaaaataaattcagccactaatgcccaaccagcaacaaatggactaatgaaaaaatagagcaatggattgataattaagaaggcaataatacaagccttataccattctggtgcgttaccgagaaagtttttataaaaagcgtcaagattattcatagatttaattaaaaagtaaaaatgattgtggattgtaatctagtttagattaaacgataataccccaagagccattatatggaaggcaatatcatttttgatgagtacatcacactttttactatttatttgaagtatttcttcattttttgagataaatcaatgaatcaatcagacattttaagagcccaaagcccagcagcccttgctgaagagtatttaatcaaaagtatttggagtaaccgctttccagctggttcagatttacctgcagaacgtgagcttgcagacattattggtgttacgcgtacaacgttaagagaagttttacagcgtcttgcgcgtgatggttggttgagtatccaacacggtaaaccaaccaaagtaaataatatttgggaaacagcgggtccaaacatcattagtacattaattcatttagatgagtctatcacacctacgattatttcaaatgttgtttcgttgcgtactagaatgggggaatactttattcccaaggcaattaaagctgatcatttagcttcttcattactcttaaaagatcttgaattacttcaaaatacggcacaagcttatgctgaatttgactataagctatatcgggaatttacctttattgccaataagcctgtttatgggttgattttaaatagttttaaagatctctatttaaaaacggcatctttatttttctccaatcctagctctcgtcaattaagttttgcattttatcaagcacttcgaagcgcttgtgaaactaatgattatgaaaaagcggtagaatgtttagcaatgagtcgtcagcgtagtgcagaaatttggactgaaatgttaaaaattttaccgaaaaattttggtgaataaaactgctaaatagtaaattttatatcataaaaatctattgtgttttacaaatggagcattttccacatactgaatctaatagattatgctataattctatgtagggtattaacaatccaataatggaaaatagataaggaaatcgcccttgtctattttccattattaatttaattattcgttttgggaggatgtatgaaaatcaaaacgttactaatgtgggcaatttcggcatttttcgctgtaatgctttctgcttgtaataaagaaccccaacaaattgcctttgaaggtaaaacaatgggaacaacctaccatatcaaatatattgatgatggtagcttaacaaatttacctaaaccagaagaggttcaacgtcaaatggatacgttgttaaaaatggtaaataacgagatgtccacctatcaaaaagactctcaaattagccaatttaatcaaatgaaagaggcagataaaccgtttgaaattgcctctgattttgccaaagtggtcaaagaagcggtacgtctaaataaagtgacagaaggtgcgttagatgtgaccgttgggcctttggttaatttatggggatttggaccagataaacgcctaaataaagcaccaacggaagaacaaattgcagaacgtgccacttgggttggtattgaaaaattagtcttagatgataacgccacaaaagccacattaacaaaaaaagtaccagagctttatctcgatctttcagcaattgccaaaggatttggcgtagataaattagcggattaccttgagcaattaggggtacaacattaccttgttgagatcggcggtgaattacgcggaaaagggctaaatttaaaagggcaaccgtggcgtattgcagttgaaaaacctgaatttgctcaaggaacatcaagtcaaattgttgtgccattgcataatttaggtatggcgacttcgggtaattaccgcaactattttgaagatgaacagggtaatcgcctatctcacattatcgatccaaaagcattacgtccgattagccataacttagcctcaattactgtatttgcaccaaccacaatgactgcagatggactttcaacaggcttatatgtgttaggagcagaaaaagcactggaagtggcagaacgtgaaaatttagcaattttcttaattatcaagaaaggcgacggatatgaaactaaaatgtcgagtgcctttgaaaaattaattaatcaaaaataataggacaaaaaatggaaacaattttactgacctttgctttctttgtagccattgtatttatgatgtcaatcggctttattatcaaaggtaaaacaattaaaggtagttgtggcggtatttctgcattaggaatgaaaaaagtctgtgactgcgatgagccttgtgataatttaaaagcaaaattagaagctggcgatgaagctgctaaagccgaatatgaagaaaaatttgccaagaaagaggctcagttttacgaagtaaaataattttttcatcaataggaaggaaaaatggagcaacaagatattcgctggaaacagcgttttgaaaattatcaacaggctgttgcttatctaaaagatgatgtagaaaagtatgcagatactgatcttgatattatcaaaaaagggattattcaaagttttgaaatcgctcacgaacttgcttggaaagtaatgcaagactatttgaaatatcaaggtcttttagatgcaaatggacctagaaacgtaactcgaatagcctttcaatatgagcttatttttgaggggcatcattggatggaaatgttgaatagctgtaatatgacagttcatatttacgatgctcaaattttgttgaaagaatttgaaaaaatcgttcacatttaccttccccttttccttgcattagaaaagagaatgatggaattatggcagaaaagtttggattaaatgaacaatctattagggtaattactgatattctcaagaaataccccgaaattgagcaggcgattatttatggttctcgagcaaagggtaattatcggatagcttctgatattgacttaacttttaaaggaccaaatcttaatcagagcatattgggtaaaatcaggttagatttagaagactctagcctaccttatctgtttgatctttcaatttatcacgaactggctcacgaaaattttattcagcatatcgacagagtgggacagcaattttatcaacggacagaacaacaataatgaaatcaaaaacttacctacaacattttcctgcacttaccgatgaacaattagcggaaaatgcaaagaaaaaagtgatctgcggaatgtcaggaggcgtagattcttcggtttctgcctttattcttcaacagcaaggctaccaagtggagggcttgtttatgaagaactgggaagaagacgatgatacggattactgcacggcggcggcagatttagccgatgcacaagccgtttgcgataagctgggtattaaactgcataaaatcaattttgccgcagagtactgggataatgtgtttgagcatttccttgcagaatatgaagctggacgtacaccaaaccctgatattttgtgtaacaaagagatcaaattcaaagcctttttagaatatgctgcagaggatttaggggcggattttattgccactgggcattatgtccgtcgtccaccgcttgaacaacagccaaaattattgcgtggacttgatagtaacaaagatcaaagttattttctctacaccctaagtgagcaacaagtcgcacaaagtcttttccctgtggggaatattgaaaaaccgattgtgcgagccattgcagaagacttaggtttagcgacggcgaagaaaaaagattcgacaggtatctgttttatcggtgaacgtaaattcaaagatttccttgctcgttatttacctgcacaagccggggagattaaaaccgtcgatgggcaagtgattggtcgtcacgatggcttaatgtatcacaccttaggacaacgcaaaggtttaggtattggtggtgtcaaaggggcgagtgaaaatgcgtggtatgtagtggaaaaagatctggtgaataatgtgctaattgtcgctcaaggtcaggataattccgcgttgctttcaaacggtctgattgcaagccaacttcactgggtagatcgtcaaccgatccgtgaaaaactacgttgcacagtaaaaacacgctaccgccaagcggatattttatgtgaaatccaaccgcttgatgacgaaaccattcgagtgatttttgatgaacctcaaatcgccgttaccccaggacagtccgccgtattttatcaaggcgaagtctgtttgggtggtgggattattgaagagcagctgaagtaatatctcctaatagtgatattgtggaagatagatttatggcataagaatggggataatagacaaatttgctgctaatatttagaaaaaataaacattagtaactagtttgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagatagaatcttctgctcaatccctttcgcatctaaccctaaatccgcataggattcggcttgcgtagcttgtgggataaagaaatcagggatacccaacattaatagcggtttgattttgccgatatgttgcaagtattcgtttactgcactaccagccccaccttgaagggcattttcttcaagggtgactaataattcgtggcggtcgacaagctctgcaattaaggcttcatctagcggttttgcaaaacgcatatcaacgagggtgtaattatgggcttctgccacttgtttggcttcgtttaataatgctccgaaattgagaatagcgacctttttcccctgttttaacactttgcctttgccgatttcaagggtttgcatcggttgaagctcaacgccttgtgcattgccacgcggataacgcacggcaacagggctgttcattgtgtaagcagtgtaaagcatttgacgcatttcattttcatcacttggacacattatcgtcatatttgggacacaacgcataaaacttaaatcaaatgcgccttgatgggtctgcccgtctgctcccacaataccagcacggtcaattgcaaaaatgacaggcaagttttgaatagccacatcgtgaataagttggtcataagcacgttgtaggaagctagagtaaatcgccactacaggcttgtaacctgcaatcgcaagccctgccccaaaggtcacggcgtgctgttcggcaatcgccacatcaaagtattgttgtggaaagcgtttagaaaactcaaccattcccgatccttcacgcattgcaggggtaatgccgataatcttcggatcacgctctgccatttcgcaaagccagtcgccaaaaatgttggaataggtcggtacggatttggtttgtggtaacttaccgcttgtatggtcaaatttcggcacaccgtggaaaccgatagggtcttgttccgctggagtataacctttgccttttttggttttaatatgtaagaactgtggtcctgacatatttcgcatatttttcagggtagaaatcagttcttcaatatcgtgtccgtcaatcgggccgatatagttaaagccaagggtttcaaacattgtgccaacaggcgaaacaaagcccttaacgtgttcttctgtttttcgcacaaactctttgatcgacggaatgcctgagagcagttttttgcccccttcacgtaaagtaccataaagcgaaccagtgaaaaggcgagctaagtgattatttaatgctcccacattttctgagatggacatttcgttgtcatttaagataaccaacatatcggtatgaattgaacctgcgtggttaatcgcttcaaatgccatacctgcagtgattgcaccatcaccaatcacacagaccgttttacgccctgcgttctctttttctgcggcaacggcaatgcctaaaccagcactaatggaggtagaagagtgtccaacgctcaatacatcaaaaggactttcttcacgccaagggaatgggtgtaagccgtctttttgacgaatagtatgcatttggtcacggcgacccgttaaaattttatgtggataggcttggtgtcctacgtcccagataagttgatcgaatggggtctgataaacataatgcaaggcaacggtcaattcgaccacgcctaatccagaggctaagtgaccgcttgtttgactgacggactctaacaaataggcacgcagttcatcacaaagaggttgaagtttatcttttggtaataaacgcaaatcatcaggtgagttgatttgactgagcaatggataggtcttttgcataagcttatctttaatcgttgggtgggcaactgcccatcaaaaaaatctattattaggctttgagttcttcagttaaggtcggttgaatactgtttaaaatttcttttacaacacgaccgctacctgccactacattacctgattttaagtaatctgtaccaccaacaaagttggtcactaacgcacctgattcacgggcaattaaatcgcctgcagcacaatcccacggttttaatccgatttcaaagtaaccatcaacacgaccagcagccacataagctaaatctaatgctgcagaaccagtacggcggaaatctgctacgccattgttcatcaaggcttcaatcatatttaagtgagcagtacgatgttttgcgactttaaacgggaaacctgttgctaacactgtgccttgtaaatcacgacgttcattactaatgcgaaggcggaattcatttaattttgtaccttcgccacgcacagcggtaaataattcgttacgaataggatcatatacaacacccacctcagtacgaccattcacacgaatagcaatcgacaccgcaaaatgtggcaagcgtttaacaaagtttgttgtaccatctaatggatcaatcacccattgtacatcgttatttgtgccagctaaaacgcctgattcttcgccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacgcctgattcttcgccaacaatagcatgatcaggatacgatttacggatcacttcaataatggctgcttctgctgctttatcaatttcggtaacatagtcatttgcgcctttttgagcaacttgagtgtcttgaggcgcttgctcatagcctttagcaataatattgcctgcttttcgtgctgcacgaatagcgatatttaacattgggttcataattccaccagattttaaagaacgtaagaggattaggattatagagaaagttagggaataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatagagaaagttagggaataaaggaatagggcgacgagatcaatttgttttaaataagattttatctggtgttgtgtagcagctgcacaacagctaattttaagaaaagttatgtaagaggggattttcgcttgtttcctcgttagattggtcaaaggcaaggaaatagagatcgaagcggatagtccctatccctacaatttaaaactggctttcaactaagatattgacgtttttatccgtacaggaatagagcgttggcaaattactattttgcttacgataggtaaattgtagccctaggtgttactcctaaccaataccaattgcgcttccatagcgttaaatttaagctatatactttgtcagaacgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacccgaatacaaggcaggttaccgatgaacgctccgatttattgtggtattgatgttgctaaacgcaatttcgtgattggtttttctcatcagaaaaagaccaaaaccgaaaccaataacgccaaaggtattcaacataccttggactatttaagccagtttaatgtggctctgataacgcttgaagcaacgggtggattagaaatccccgtggcaaaagcccttgctcgagcaggttatcgtgtatttattgctaatccactgaaagccagtgagtttgcaaaatctcaaacgagagccaaaaccgatgcaaaagatgcggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgtctaaattgatgattccaccgaactctgtttttcatgtaaataagcttaaaaagctctcctattgtaaaaacgtttacaagtaaatgtactgtgttttacaacaattacaaatgttttcgtttgcttgattttgaggcaatgtaaagtagtttgttgtttttgctgcgggtaatgaattctatttataattaaatatattcgtatttttctgacaaatttcttgcccctaatctacgaaaactataaaattctccacttaaagtgggaaaaagtggtgttttgtggaattttttccaaatttccgaatctctaaggttaagtgagcaaaaaaatgtttcgtggagcaacttcaatcagcattgatagcaaagggcggatcgctattccgacccgttatcgtgccgagcttttggagagttaccacgggtcatttgtttgtaccgtagatattcgccagccttgtttattattgtatccgttgcacgaatgggaaattatcgagcaaaaattgctcgctctgtctaacttcgatcctgcacagcgtcgtattcaacgggttatgcaaggttttgcgacagaatgtgaaatggattctgctggacggattttacttagcccgactttgcgtcagcacgctcaattagaacagcagattatgttggttgggcagttaaataaatttgaaatttggcaagatcaacaatggcagaaacagattagcgaagatcttgcaattggtagctcagaagaaatgcttcattgtgaggcattaaagaacctttctttataacaataacggataatcaaaatgagtgactcacccaaacatattacggtgttattacacgaagcagttgatggtttagccattaaacccaacggtatctatgtcgatggtacttttgggcgtggtgggcattcacgtcttattttaagcaaattgggtgaacaaggcagattgattgcgattgatcgtgatccgcgtgcgattgcagaagcgaacacgatcactgatccccgttttcaaattgttcacagtgctttttcatccattcctgatatttgtgacgaacttaatttagtcggcaaaattgacggtatcttactcgatcttggcgtatcttccccacaacttgacgaagcagaacgtggttttagttttatgcgtgatggaccattggatatgcgaatggacaccaccaaaggcttatctgcaatggaatggttagcgcaggtatctgttgatgatcttgcttgggtgttaaaagagtttggcgaagagcgttttgccaaacgtattgcacaagcggtggtttcttacaataaatctgcaagtgaaaaaatttcgcgtaccttacaactcgcccaaattattgcagatgccgtgccctttaaagataaacataaacaccctgcaactcggtcttttcaggcaatccgcatttacattaatagtgagttagatgaattagaaaaagcgctaaattcagccttagctgtactcgcacctgaagggcgtttgtctattatcagcttccattctctagaagatagaatggtgaagcagtttatgcgcaaacagagcaaaggcgaggctgtgccgaaaggtctgccgattttagaaagtgagttaaataagaatattcctttaaaaaccgtcggcaaagcgattatgccaagtgaagcggagattgaagccaatccacgctcacgcagtgcggtgttaagagttgcggagaaaagataatgtcgagtgaacgctatcctttacgtcaagtgattttagacgatttaactagccataataaagtggcgttattgctacttgttggggtggtgattagtgctgttgcaacgatttggattacgcaccaaacacgtttattaacagcagagcagggaaaattattgcaagtaaaacagaagcttgaaaatcagtatgttcatttgcaattagaagaaaattcaaaaagtcagaagtttttagtcgaagctgttgctgaaaaatttggattacaaccagttaaaaaagaacaagaaatcattttagtggaataaaaatgaaaaaatcagtgaaatataaccctaaaaataaaaatacgatgggagatgaattaaaagaggtagatatttctccccagcctagttttttgcctgcccgatttggatttgtttatctgtttatcggtgtaatggtctgtgccttgatcggtcaaagttttttcttacaagtcactgattcagaacgtttaatcaaagaagcaaatgatcgctctttacggacaaaagagcttccttttacaagggggaaaattttagatagaaatgggcgagtgctttcaattagtgtgccgatgtattcaattacgattgatcctaaagaatattttgatactaaacttcgtcgtaataaatcgttatggcgagttttggctatggaaatggaggcttcagccagtaaaattgaagctagtgtgaatcgttttattaaagaaaaaccacagaataaagaaaataaatatgatcctagagcgattttaaacaataaaaatgaggattattggacattactcgctcgtgcaactgcattagattacaacgtattaattcaacgcatacgcaataatccaaattctatgtttttacatttggaaaatgagtatgcccagcttgaacgccaaaaaatgcaagagttagccaaagcattagatatgaaatacagcgtaatgatggataaactttatgcttcagcaaatcaacgttttttatatatttctcgtcacgaatcagatgtgataggagattatgctcgagcattaaaaattgatgggcttgtattaaaagcagaaactcgccgtttttatcctcttgcagaagaaatttcccaattaatcggctttaccgatgttgatgataaacaaggtacggaagggcttgagcgtagttttgatagcttattagtgggtaaaaacggtaaacaagtcattcgtaaagatgcccgtggcaatgtgattgagcatattcgcgatgagaaaaaatatgatccgcaagatgtgatgttgagcattgatgaagaacttcaatcgatggtttaccgtgaaatcaaaaaagcggtaattgaaaataaggcagaatcaggaacagctgttttagtggatattcaaacgggtgaagtgttagcgatggcaaatgcaccatcttttaacccaaataaccgtgcagaattcaaatcagaattagcgcgtaaccgagtgattaccgatacttttgaaccaggttcaacagtaaaaccactggtggtattgacagcgctacaaaataaagtgacttatccaagtgaagtcattagcacaagaccttttgtcgttaatggacatacgattaaagatgttgctcctcgcgatagtttaacgctgacggggatcttacaaaaatccagtaacataggtgtaagccgtttagcgttaagaatgccatcaaccgcattagtcgaaacttatagcaaggtcggttttggtaaagatacaggcttagggcttggtgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgtggtacaaacggcgatcgtaaacgttgggcggacattgaacgtgcgacaatggcgtatggttatggtttaaatgtaacgccattacaattagcccgagcttatgcaacattaggcagttttgggatttatcgtccgctttcgattacaaaagtggatcctccagtaattggtgagcgtgtgttgccagaaaaaatcaccaaagatgttgtacatatgatggaaagtgttgcagctaaaggcgaaggtggagcaagagcagccgttgatggataccgtgtggctattaaaacaggtacagctcgtaaattagaaaaaggcaaatatgttgaaaaacatattgcttatacagcaggtattgcacctgcgagcgatcctaaatttgctttagtggttttaatcaatgaacctaaagctggcaattattacggcggtgcggtatctgccccactgttctcaagcattatgggacatactttaaaaacaagaaacattaaaccagataatcttactgaagatacaaaaagtgcagtgagagagatgaaaacaaattcgataaactaagaggcaataatgaaccctttactttcctttttccctgaacttaaccattggggcgaattaaaagaattaaacaaaatgaccttggacagccgtcaggttgaaaaaggtgatctatttgttgccttaaaaggacatcaagtcgatggtcgtcaatttattgaaaaagcgattgaacaaggtgcttctttagttttagctgaagcggacgatgacgttcaagcggtgagatttgcagaaaaatttgcaaattcgaccgcttgtgtactggaagtaccaaatttaccgaaacaactttcggcaattgctggagcgttctatggcaatccgtcagaaaaattaacccttgtgggtattacaggcactaacggcaaaaccactacggcacagcttttttcacaatggcgaaacttgcttggcggtaaatctgcggtgatgggtactattggcaacggactatatgggcaagtgcaagaagcggtgaatacaacaggttctgccgttgaaattcaacacaatctggtgaactttgtcgaattaggggcggatttctgtgcaatggaagtctcttctcacggtttggctcaatatcgtgccgaagcgctagactttgacttggcgattttcactaacttaagccgtgatcaccttgattatcacaacacaatggaagagtacgcccaagcgaagctccgcttatttggcgagctttcttcaaaacaacaagtaatcaacgctgatgatgaaattgggcgtaaatggttagcaaaattgcctgaggccgtcgctgtcagcaccgatagccagtttcaaccacaacaagcccgttggattaaagccaaagccgtacaatttaccctacaaggtgcaaccattgaatttgaaagtagctggggcaacggcgaactcaaaagccgtttaatcggggcgtttaatgtcagcaatttattaaccgcttttgctggtttattggctttgggctacgatttgcaaaaattagtcgaaaccgcaccgctgttaaacggtgtatgcggacgtatggagtgtttaatcagcgaagaaaatgcggaagaaagcccgatggtgattgttgattatgcccatacccctgatgccttagaaaaagccttagatgccgctcgtttgcattgtgaaggcgaactatggtgtgtgtttggttgcggtggcgaccgtgatacaggtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtggcgaccgtgatacaggtaagcgtccgctaatggctcgtattgccgaacagttggcggacagagtgattgtgactgatgacaacccacgcaccgaagatcctgatgtgatttttaatgatgttatgaaaggtttccgcaagccaaaagcggtgcagtctatgcatatccgtcaatatgcgattgaacaagcgattgcccaagccgaaccaaaagatgtgattttaattgcaggtaaaggacacgaagattaccaaattatcggcacgaagaaatatcatttttcggatcaagagtgggcgaggaagtttttggggtagttggaatttaatctattgcacaaaataatttgtaggggcaaattacatttgccccaaaagcaatcataaggaagaggggctaatgtaattagcccctacaaaagtagattttaaatagtaaaaataatttataagtaaataaagatgataaaacaaaccacccaacaactcgctcaaaccctaaagggtaaactactcggtagtggcgaggttgttgctgaaaacatcagtacagatacgcgtcaagcggtcgaaaaaggtttattttttgtattaaaaggcgaaaaatttgatgctcacgattatgtagaaaaagcgatagaacaaggctgtgtggcgttagtcgttgagcgtgaattggcggtgaatgtaccgcaaattattgtggaagatactcgcttggcattagggcagttagcaaaatggctgaaagcggaaattaacccaaaaactgtggcaatgacgggctcttcaggcaaaaccaccgtcaaagagatgactgcaaaaattttgcaaaaagtaaccgcttgtgaagatcaggtgctttatacttttggcaatttaaacaatgatttaggtgtgccattgaccttattacgtttaacccctgagcataaatttgccgtggtggaactgggggcgaaccatatcggcgaaattgcttacaccaccgaaatagcacaacctgatgcttgtttagtgaataacgtggcatctgctcatcttgaaggatttggttcattggctggcgtggctcaagccaaaggcgagatttatcgtggcttgaaaacaggcggtaaagcgattgtgaatttagcccattactaccctgaatggcaaaaagagattggcgatcacgagttgcaatcgttctgttacacaggcgaagataaagacagttatgtagatttttgggcggaaaatgttgaactacatcttaatggttcacgctttactttgcataccccacaaggcgaaattgagatcaatctgccttatttgggcgaacataatgtaagtaatgcgttagcagcaacggcactcgcaatggcagtcggggcggatttaactgcggttaaagctggattagaacagcgttcagcggttaaagggcgtttgtatccgattgaaattaaagagaatgtgctgtttattgatgacagttataatgcaaacgtggattcaatgaaatctgcggtatcagtgttaaaacagtatccggctttccgcatttttgtggcgggagatatggcggagcttggcaaagacagccctgcttgtcatcaagaagtcgccgatttcgttaaacaggcgaagttagatttagtggtcagcttcggcaaagagagtgaggtgattagcggtaattcagctcaccactttaatgacaaaaccgcaatggcggcgtttttgcttccgattattttgcaaaaaatcgagcaaaaccaaccgcttgttcttttggcaaaaggctctcgtagccaaaaaatggaagaggtaattgcttccttatgtcgttcttttgatgtttctttttaaggattagcttatgttagtgtggcttgctgaatatctggtgcaatacaacacagcgtttaacgtggtgtcgtacattactttccgttccattatggcgttattgacggcgttaattatcggcttatggattggatcgacggtcattcgccgtttacaaattctcaaattcggacaggaagttcgccacgatggccctgaaagccactacaaaaaacggggcacgccaacgatgggcggtattatgattttattcgctatcggtgtgagtacgttgttatgggcggatctacgtaacccctatgtctggtttgtgctatttatcctatttggctatggggttgtcggttttgttgatgattattggaaaatcgctcgtaaaaataccgatggcttgattgctcgttggaaatatttttggttatcggtgatcgccttagtgtccgcttttggtatgtatgcgattggtaaagataccgcggccacccagttagttgttcctttctttaaagatgtgatgccacagctcggcttattctatattgttctaacctattttgtgattgtcggtacaagtaatgcggtgaatttaaccgacggcttagacggcttggcaatcgtgccgcttattatggtcgcaggggcatttgcattaattgcgtgggcaacggggaactataattttgcacaatatctgcacattccttatatcaaatatagcagtgaattagtgattttatgtacggcaattgcaggggcaggtttaggtttcttatggtttaacacttacccagcacaagtctttatgggggatgtcggttcattgtcacttggcggtgcattgggggtgattgccgtattagttcgccaagaattattactagtggtgatgggcggtgtctttgtggttgaagccttatcggtgattttacaagttggatcgtacaaacttcgccaaaaacgtattttccgtatggcaccgatccaccaccactttgaacttaaaggctggccggaaccacgtgttatcgtgcgtttctggatcattaccttaatgttagtgttaattggattggtgacgttgaagttacgttaattaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattttaatatacaagggacatagggacacactgcgtgtgtccgctacagttttaccaaccgaggaataatgaaaataaagcggacacacgcagtgtgtccctacatctgaaaataccgtttctagagaacaacaaaatgcaaaatcaatatcaaggcaaaactatcacaattatcggcttaggcacaacaggcttatcttgtgtcgaattttttgcggacaaacaggctcaagtgcgagtgattgatacccgagcaaatcctgcaggggcggataagttgtcgaaggatattccactacacacaggcagtttaaaccttgagtggctattaagctccgacttaattgtgattagcccgggacttgctttagcaactgctgaaattcagcaagctattcaagccggtgtggaggtggttggcgatattgagttgttctgtcgtgaagccaaagcgccgattattgcgattacaggctcgaacggtaaaagtaccgtcacgactttgacgactgaaatggcaaaacaagccggagttaaagttggaatgggtggcaatatcggcgtgccggcattgagtttattgaaaggcgattacgagctttatgtgttggaattatcgagttttcaacttgaaacgacctattctttaaaagcaaaagcggcgaccattttaaatatcagcgaagatcatatggatcgctatgagagcattgaagattatcgccaagcgaaattgaaaatttatcaccatgccgaaaatgtaattgtgaatggcgaagatccgcaaactttccctgaacaagcggtcggatctttgaaaaaatttgcagaaaaagacgcagaatataccgcttgtaatggagaactctattctggcgatgaagccgtgattgcgattgatgagctgaaaattactggtcgccacaatgtgatgaatgccttggcttcaatggcattggcggaagcggctggtgttgctcgttcagggattgtgaaagccctacaaagctattcaggattagatcaccgtttccagctagtaccgacgaatgatggcgtacgctggattaacgactcaaaagccacgaatgtcggcagtactgtggctgcattaaatggtttacaagtcgaaggaacgctttatctgttgttgggtggcgatgggaaagatgctgatttttctgagttaaaaccttttattaatcagccaaatacagtctgttactgctttggaaaagatggggcggaacttgccgctttaactcaaaatagcgttttagtggaaacaatgacacaagctgtcgcacaagttcgtttactattaaaatcaggcgatatggtgctactttcaccagcctgtgccagtttagatcagtttaaaaattttgaagagcgtggcagacagtttgtggcgttggctcaaggggttatctaatgctagaaaaaattcggattgagtgggataagtggacaagattaacgcctgttaatgcactctatgatcgaacattggtgtggttatttctcgcattgctgatcattggatttgttatggtgacttcagcctctattcctgtgagtagtcggctacacgaagaccccttctattttgcggtgcgagatggtttttatgttatcgcatctatttgtgcttgtgctttctttgttcaaattccaagtaaatattgggaaaagtataatggttggttatttatttcagccctacttttgcttgcaattacattgtttgttggaaaaacagtaaatggagcaacacgctggatccctatcggtcctattaatttccagcctgcagaattagcaaaatttgcggtgatttgttactttgcgagcttctatgtaagaaaatttgatgaaatacgacaaaaaagcattagtttcattcgccctatggtaatcctgattttatttagctgcttgttgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcaacctgatttgggaagtatagcggtgctttttgtgctgacatttgcaatgctttttattatgggggcgaaagtcttacagtttatttttcttggtatcacaggcgttgtagtctttgctctattagttttaacatcggaatatcgcttaaaacgcgtaacttcttttatggatccttttgctgatgcttatggcgatggtttccaactatctaactcacaaatggcgtttgggcaaggcgagatttgggggcgaggattgggtaattctgtgcaaaaattagaatatttacctgaggcacataccgattttgtgatggcagtcattgcagaagaatttggattagttggaattgttatcgttgtgctattattactcaccttaactttcagagctttaaaagtcagtcgtgaagcgttaatactagaagaacgatttaaaggtttctttgcttttggtattgccatttggatttttattcaaggctttgtaaaccttggtgttgcttcggggttactgccgaccaaaggcttaactttcccattggtgagctatggtggttcaagtttagtgattatggcgattgcaattgcggtattaattcggattgattacgaaaaccgcttagatcgaattgggcacgcacatttaagtgatgattagtgttggaaaataatatggcaaaaaaattattggttatggctggcggaactggtgggcacgtttttcctgcgattgctgtagcaagagaattacaacaacaaggttgggagatccgctggttaggaacaaaagatcgaatggaagcggatcttgtgccaaagcacggtattccgattgagtttattcaaatttcaggattaaagggcaaagggatcaaagcattacttactgccccttttgcgatcttaagggcggtacttcaagcgaaaaaaattattaacgcgtacaagcccgatgcagtacttggaatgggcggttatgtatccggacctggcggtattgcagcgaaattatgtggtgtgcctgtgattttgcacgaacaaaatgcggtggtaggtttaacgaatgtatggctttctaaaattgctcgacgtactttacaagcatttccaacggcgtttccaaatgcggaagtggtgggaaatcctgttcgccaagatctatttgaaattgcaccgcctgaacaacgttttgctgaaaaaggctatccgatcaatatcttagtgatgggcggtagtcagggggcattggtgatcaataaaaccgtgctggaagtagcgaaagtgttaggacaaaacgtatttattagtcatcaagtcggcaaaggcaaattagccggtgtggaagaagtttatcaagcaacaggtaacggcattgctagcgaatttattgatgatatgaaagccgcttatgaatgggcggatttggtgatttgccgttctggtgctttaactgtatgcgagattgctgcagcaggattgcctgcgatttttgtgccgtttcaacataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagatcgccaacaatttttaaatgcagagtaccttgcacaagtaggtgctgcaatgattattgaacagcaggattttacccctgaaagtttattaaaagcattagagccgttaattgccgaccgtcaaaaactgacggaaatggcaatcaaagcaagagcgaaagccacaccattagccgcaaaacgagtggcagaagtgattgtggaaaatagtttgtaagcggtcagattttgtagtttttttgcaaaatgatcaaatataaggaataaaaatgaaaaatttccaagataaagttaaaaaattagtcgctgaaatgcgccgtgtaaatcaaatccactttattgggattggtggcgcaggtatgtctgggattgctgaagtattattaaatgaaggttatcaaatttcgggctcggatattgctgatggtgcagtcacgcaacgcttagcaaaagcaggtgcaaaagtttttatcggacatcaagctgaaaacattgaaggggcaagtgttgttgtggcttccagtgcaattaatgaaagcaatcccgaagttgcggctgcaaaagaagcacgtattcctgtgattcaacgtgcgcagatgttagcggaaattatgcgtttccgtcacggtattgcgattgcaggaactcacggtaaaacgaccacaaccgcaatgatttcaatgatttatacggaagcaggattagatcctacttttgtaaatggtggtttagtaaaatcagcgggtaaaaatgctcatttaggtgcaagccgttacttaattgcagaagccgatgaaagtgatgcgtcattcttacatttacagccgatggtttctgttgtgaccaacattgaaccagaccatatggatacttacggtggcgatttcgagaaaatgaaagaaacctatgtacgtttcttacgcaacttaccattctacggtttagcagtgatgtgtgctgatgatgaaacagtgatggaaattgccccaaaagttggtcgccaagtgattagctatggttttagtgaaaaagccgattaccgtattgaagattatcaacaaacaggcttccaagggcattatacggtggtttgcccaacgggtgagcgtattgagatcttactaaacgtgccgggtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggtaaaaataatgagcttaaaaaacgaaaaaattgcggtgttatttggtggcgtttcagcagaacgtgaaatttcgctcaattcaggcaaatcggtgtttgaagcattacaaagtttaggttataacgttgaagcgattgatacaaaagaatttccgattgaaaaattaaaagaaaaaggcattcagcgtgtatttaatattcttcacggtggtattggtgaaaatggcgtgcttcaaggggcgttagagcaactcggtattcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttagagcaactcggtattccctatacaggctgtggcgtaatggcttcggcgattactttagataagttccgcaccaagctattgtggaatgcagtgggcttaccaacagcggcaatggaagtggtacgccgtgggcaagcggtcaactccgatgaaattattgcaaaattaggtttaccattatttgtgaaacctgcgagtgaaggctcaagtgttggcgtaagcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagttattacctgcaatcgaagaagcattaaaatatgattcaattgtgttggtggaagaaaatttagcaggggcggaatactctgtgccagtacttgatggtgaagtgttgcctgcggtgcaaattattccagacagcgagttttatgactaccacgcaaaatatatttcggataatacccagtatgttgtgccagcgttaaatgctgatcgccaagcggaagtcgctaagttagtgaaacaggcttatgatgtggtgggctgtcgtggttggagccgaattgatgtaatggaagatggcgaaggaaacttccgtttagttgaagtgaatacttgcccaggtatgaccagtcatagtattttcccaaaatcagcggcgactgtgggttatagtttcgagcgtttagttgagcgtgtattggagttaagtgcgtaatggttgcggtaatacgtaagaaaccgacttcggtaattcgtacacaagcaagtaagccgaaatatccgattaattggtttgtttttgttaagcctatcgttgtgttattatgtttcggtatggtttatgcaatttataccaattggtctagtttgcttgcatcactggatagaacgccaatccgttcttatgcattaacgcataaaacacaatttacgacgaataatgatattcgtgaagttttagctaaagaacccttgttaaaaggctattttgaacaggatattcaagaaattaaagagaaatttctaacaattccttggatcagtaatgtttctgtgagaaaagtttatcccgataaattaagtattacgttacttgaacatcgtccaatggctgtatggaataatagtcagtatgtttctgaacatggagtagtgttcagtttgccgaaagataggtttgataacacaggcttacctattttatacggaccagacacagaaagtaaggttgtgcttgaggcttgggataaaataaaagcagatttaaaatcacgtaatttaggattatattccattgcaatggatagtcgaggagcttggtcaattcgacttgataatggcgttgaactaaaattagggcgaggggaatggctacccaaaatcgatcgttttgtgactatttttcctgaaattgatattccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcctgaaattgatattcctgaggggaaacgtttatcctacgtagatttacgttatgaacacggggcttccgttggatttaataatcaataatttattaacttgcaaacataattaatatgacaaaagtagcagaatctagaattagagtaggtttagaaattggaacacacaagatagttgctgtggtaggtgaggtattgcctgatggggtgattaatgtgattggctctggaattagcccgtctaaaggtgttcaaggtggtggcgttgttgatttagatgctgtaacaagtgctattcaacgtgcgattgaagaagctgaatcgatttctggatatgatattgtatgtgttactcttgccctttcaggatctcacattacagcttttaatgaaagtggaactgtgccgttgtctggtagtgtaagaaatgaagatttggataatgctattcatattgctcgttctattaaattacccgatgggctggaaacattacacatcattcctcaggaatatagagtagatagattacctgctactaaaaatccccttggtttatctggtatgcgtttgcaggctcaagctcatttaattgcttgccataacgattggctacgtaatttaaaaaatgcagtggagagaagtaaattaaaaattgatcaaatcgttttttcggggcttgcttcaagttattctgtgttaacagaagatgaaaaagaacttggggtttgtttaattgatattggcggtggcactatggatgttcttgtttatacagatggtgctttgcgttttagtaaagttattccttttggtgggaataatgtaacggactatattgctcatgttttcacaacctctcgccaagatgcagaaaatattaaagtacagtatggatgtgctattgcacccccaactcattttccagagaaaaaaattgaggtggcaggcttgggtggacgaatgccaagaacttttacaaaaagccaattatctaatgttacatctcaatgctaccacgatttactgagcgtaattaatcaggaattatcccaattacgcaatgaactatatcaaaaaggcataaaacaagaattaattgctggaattgtattaacaggtggtggctctcaggttgaagatattgtagaatgtgcaaaatctgtctttggatcacaagttcgggttggtaatccattgaacattacaggattaacggattatgtaaacaaaccttcttatgcaaccgtattaggattgctacagtatagtcattataatgacgttgatagtagccaaagtggagaaattagtcataaggtgggcggcattattgatacattaggtcatagtgctaaaaaagcgtataattggataaaatcaagtttttaataggcattaataacaatattaagccgtgagggagaatcacaaatgtttgaacctatttatgaagcaacgcaagatgcggttatcaaagttatcggtgtcggtggcggtggtggtaacgcactaaatcatatggttagtaaccaatctgatgttggtagtgttgaattcttttcggttaatacggatgcacaagtattacgtagtagtgccgttcgcaatacgattcaaataggtgcaagtgtaacaaaaggcttaggggcaggagcagatccaaacattggtcatcaagcagctgaagaagatagagaagcattaacgaatatgcttacaggtgctgatatggtcttcattgctgttggtatgggtggtggcacaggtactggtgcagctcctgtaattgctgaaattgctaaaagccaaggagcattaacagttggtattgttactaaacctttctcttttgaaggtagaaaacgttctaactatgcggaacaagggatccgtgaacttgcaaaacatgtggattcactcatcattatccaaaatgataaattactaaaagtattacctaaaagtgtaaaatttaatgaagcctttggcgttgcaaatgacgtcttacgcaatgcggtattaggtattacggatatgattacttccgaaggtcttgtgaacgttgactttgcagacgtgaaaaaagtgatgtcggaaatgggtagagcaatgatgggaacaggcattgcagagggtgaaaaccgtgcagaaaatgcagcaaaagaagctgtagcaagcccgttattggaagatgttgatttatcaggtgctaaaggcattcttgtgaatatttcttctggctatgatattgaacttgcagaagtcaataccattatggaatatgttactagcttcgcagatcctgatgcagctattatttttggttctgcattctatccagaaatggatggtaagatccgtgtaacattggttgctacaggtatcggacaaccagaagaaatgccaaaaattccaagtgtgcaaggaagaaccgatattccgcaacaatctattattaataacggatttggcggtgctcgtcagcctgaatttataaataatatgggcggttacccaaaccaaaaccaatatacaacgcatcaaatgtctcagcaaccacaacaggttcagcaaacagctccaagaccacagaaagttgatacagcgcaggtcttttcgccgaactcaatcccagggtttatgagaaatggtcaataaccatttcgggaaataaggaaacgatatgattaaacaaagaacccttaaacaagcagcaaaagtaacaggtattggcttgcacagtggcaagaaagtaaccttaacgttgcgtccagcacctgcacatacagggattatttacgcaagaacagatcttgatcctgtcgtttacttccctgcaagtgctgaatctatccgtgatacacaactttgtacttgtatgatcaacgatgaaggtgtgcgtatttcaacagtagaacacttaaatgcagcaatgtctgcgttaggtttagataacctaattgtagaagttgatgcagccgaaattccaattatggacggtagctcaagtccttttatctatctcttattagatgcagggattgaagaacaagatgtgccgaaaaaatttattcgtattaaagaaagtgtacgagtagaagaaggggataagtgggctgagtttaaaccttatagccacggtctgaaattagactttactattgactttacgcacccaatgattaccaaagaagtgcgtaactacaaaatggaattttcagcacaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactttattcaacaattaagccgtgctagaacctttacctttatgaaagatgttgaatatcttcaatctattggtcttgcattaggtggaagtttagataacgcaattgttttagatgaataccgcattttgaatgaagaagggttacgttttaaagatgaactagttcgtcataaaatgttagacgctgtcggtgatttatttatgtgtggctacaatattttaggtgatttcaaagcctataaatcaggtcacagcttaaacaataaattattacgagctgtgttagcgaatgaaaatgcttgggaatttgtaacctttgatgataaagcagaggttccgcaaggttatcaagtgacagaacaggtgtttatttaatagttattatcatttctcggagatttttattaaatttttaaggtgttttttcttaaaattctaatttttaaaaatttttgcagaaaaattgccgcttgctattcccttattctacattttcggctaatctcgcagacttcatttaccttggtaaatgaagtcttttttatttgtcttacaggaaattttatgagtaaccaatctttatcttcaaaaatccttggcggtaatttagtattacgcattgccgtaggtttagtgctaggtatctgcttagcattagttagcccagatgcagccaaaagcgttggggttctcggacaattctttgtaaaatcattacgtgcaattgcaccgattttagtttttgttcttgtaatggcttccattgctaacaaagaagttggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatagccgcttaaaacctatcttagtgatgtatgtcttaggtactttcgttgcagcagtaacagcggttattttaagctatttatttccaacgacacttgaacttgttaccagcccggaagggcttgcaccgccacaagacgttggtgaagtattaaaaaccgttgttttcaacttagtcgataacccacttggtgcaattacgaacggtaacttcatcggtattcttgcgtggtctatcggtttaggtatcgcattacgccacgcagcaccaagcaccaaagtcatgttaaacgacatctctgatgctgtttctttcgtggtaaaagtggtaatcgcctttgctccaatcggggtgttcggcttagtagcagaaaccatggcaaccaacggtgcagatgcctttatcggttatgcacgtttattagcggtattgttaggtgcaatggcaattgtggcatttatcctaaacccattattagtgtattggaaaattcgccgcaacccatacccactcaccatcacctgtttacgtgaaagtggcgtgacagcattctttactcgtagctcagcagcgaacatccctgtaaatatgggattagcgaaacgcttaggtatcaaagaagagatttactctatcgcaatcccacttggtgctaacatcaatatggcgggtgcagcgattactatcaccgtattaaccttagcagcaacttacacccaaggtatcgtgccggatttctcaacagcggtattattaagtattgttgcttcaatctgtgcttgtggtgcatctggtgtggctggtggttcattattattaatcccacttgcatgtagcttgttcaacattccaaacgatgttgcagcacaagttatcggcgtaggtttcatcattggtgttatccaagactcagctgaaacagcacttaactcatcaacggacgtattatttaccgcagcggtaagtatgtctgatgagaaaaataactagaattcttgtatacttttaatagttaaacactagtaaaagacttaactacatcagtcaagtattttagataagcagaaaaatagctgctataaaattgactatagccttatattgaaggctatagtcgtttactaggtctagatttttctctattttataaattttcattctaatattctcctttccttttccctttcctgtaattttcaggtacaatccgccgattatttttcttttatcaataacaatacaataggacatttactgcccttatgaaaatgcagaacattcgtaacttttctattattgctcatattgaccacggtaaatcgactttatctgaccgcttgatccaaacttgcggcggtttgtcagatcgtgaaatggaagctcaagtgttagactctatggatcttgagcgtgagcgcggtattaccattaaagcacaaagtgttaccttaaattatcaagcaaaagatggtcaaacctatcagttaaactttatcgatacgccaggacacgtcgatttctcttatgaagtttctcgttccctagccgcctgtgaaggggcgttgttggttgttgatgctgggcaaggggtggaagcacaaactcttgctaactgttacacggcaattgagatggatttggaagtagtgccgattttaaataaaatcgacttgcctgcggctgatcctgagcgtgttgcagaagagatcgaagatattgtcgggattgatgcgatggaagcggtgtgttgctcggcgaaaactggcgtggggatcgatctcgttttagaagaaatcgtggcgaaaattccagctcctgaaggtgatcctgatgcaccgttgcaagccttgattattgactcgtggttcgataactatttaggcgtggtttcccttgtgcgtgtcaaaaatggtgtgttgaaaaaaggcgataaaatcaaagtgatgagtacagggcagtcttatcaagtagatcgtcttggtattttcacgccaaaacaagttgatactacggaattaaaaacaggcgaagtaggttgggtagtctgtgcgattaaagatattttaggcgcacctgttggggatactttaacccatcatcacaatcctgcaagcgaagtgttacccggctttaaaaaagtaaaaccgcaagtttatgcaggtttattcccgattagctcagatgattatgaagcgtttcgtgatgcattggcaaaattgagcttaaatgatgcgtcgcttttctatgagccagaaaactcaacggcattaggctttggcttccgctgtggcttcttaggcttgttgcatatggagatcattcaagagcgtttagaacgtgagtatgatttggatctcattaccacagcaccgacggtagtctatgaagtggaacaaacgaatggcgaaattgtctatgtagatagcccgtcgaagttgcctgcgattaacaatattgcggaaattcgtgagccgattgcagaatgtaatatgcttgtaccacaagagtttttaggtaatgtgattaccttatgtgtggagaagcgtggtgtacagacgaatatggtttaccacggtaaccaaatcgcattgacttatgaaatcccgatgggtgaagtggtgttagatttcttcgaccgcttaaaatcgacttcgcgtggttatgcgtcgttggattatggtttcaaacgtttccaagcggcagatatggtgcgtgtagatattatgatcaacggcgagcgtgtcgatgcgttagcgttaatcgtccacaaagccaatgccccttatcgtggtcgtgagttagtggaaaaaatgaaagagttaattccacgtcagcagtttgatattgcgatccaagcggcgattggtaaccatattatcgctcgttcgacggtgaagcagttgcgtaaaaacgtattggcgaaatgttacggtggtgacgtaagccgtaagaaaaaactgttgcagaagcagaaagaaggtaaaaaacgtatgaaatctttaggtaacgtggaagtgccacaagaagcgttcttagcgattttgcacgttgggaaggattagtgaatagatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataattttaatatacaagggacacactgcgtgtgtccgcatacaacattcatatctattctattgataaatgttgcaatggacacactcagtgtgtccctacattttggatagtaaataaattccaaaaggagtgaattttaaatatgagcaatattttaaccattagttttattgcagtattgtacggtgtttggaaagtgttggactcaatgcagctaccaaacacgatttccattatattagtaggtttagttgttatttgtggtggcttttggtcattttacaaatttagtgctgaacctcgccgcttgcgtgcgattgagcgtgaagaaaagcgtttaggcaaaccgctctcagcagaagaaaaagccacaattcaacctcgttcattagtgggggatttttttgcgtcactatttggggtgttagcattagtcactattttacgttcatttatttttgagccgttccaaattccaagcggttcaatggagccaacattacgcgtgggtgattttctgttagtgaataaatttacttatggaattaaagacccgatttggcaaaatacgcttgttccgatgggtaagcctgaacgtggggatattgtggtatttaaagctccaaaacagccacacgttgattatattaagcgtgttgtgggtgttggtggcgaccgtgtgaaatatgatttccatacccgtaatttaaccgttgttcacggcgattcaggcaaagaagtggtgtttaaatacgaaggcagtgcaccaaatcctgactttttctaccacggtgaaatgcaagttgaacgcactgaaattggtgatgttacccaccaaattttaaataatccgcacgcttttaactacgagccttatttcttcaaacaagacggtattcctgctggggaatgggtagtgccagaagggcattattttgtaatgggagataaccgtgataacagcgaagacagccgtttttgggggtttgtccctgaaaagaatatggtcggtaaagcaagtgttatttggttaagccttgataagaaaccgaatgaatttccaagcggattacgttttgagagaatgtttacggcgattaaataaagagaacatttccccctttgaaaaagggggattaagggggatttttaaagggtgaattttattcaatgttagcaaaatcccccctagccccccttttcaaaggggggtattccacgaagataaactaaaatgcaactagaacgattacagaaaaaattaggttatcaatttgctaaccttgattacctcacccaagccctcactcaccgtagtgctgcttccaaaaataatgaacgccttgagtttcttggcgattccatcttaaattttgccattggtaaagccctatatgaaaaattcccaaaagcgaatgaaggggaattaagccgtatgcgtgcggcattggtgaaagaacagacccttgcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtcagtttgagttaggcgaatatatgaaattaggggctggagaattaaaaagtggtggctatcgccgagagtctattttatccgattgtgtggaagcgattattgccgcggtatatttagatgctgggattgatcgggcgatggaacgtgtgcattgttggtatcagcaacttctaaatgacatgcaactaggggaagcacaaaaagatccgaaaactcgtctgcaagagtatctacaagggcgtaagctacccttaccaacttacgaagtgattgatattaaaggcgaagcccataatcaaacttttaaagtcagttgtaaagtcgaaaaagttgatgaaatctttatcggtaacggcacaagccgtcgcaaagccgagcaagatgcggcattgcaggtgataaaggtgttgggaataaaatagcctaatgcaaggtggctcttgacccaccatttcaatttgtatttatttaagagaacacaatgacagatcaaaaaacatattgcggctttattgccattgttggtcgcccaaacgtagggaaatcaacgctattaaacaaaattttaggacagaaaatttcgattacatctcgcaaagctcagacgacacgtcaccgcattttagggattaaaaccgaaggggcgtatcaagagatttatgttgataccccagggcttcacattgaagaaaaacgagcgattaaccgcttgatgaaccgtgcggcagccagtgcgattggtgatgtcgatatggtgatttttgtggtagaaggcacgaagtggacggacgatgatgagatggtactcaataaattgcgttcgaccaaagcccctgtgattttagtgattaacaaagtggataatatcaaggaaaaagaagaattattgccacatctgaccgctttatcgcagaaattcccatttaaagagatcattccgatttcagctcaacggggcaaaaacgtacatattttagagaaatttgtgcgagagtcactcaaagaaggcattcatcactatcctgaagattatgtcaccgaccgttcgcaacgttttatggcgtcagaaattatccgtgaaaaattaatgcgttttatgggcgaagagttgccttattcggtgacggttgaaattgagcaatttaaaaccaacgaacgtggcacttatgaaatcaatggtttgattttagtggaacgtgaagggcagaaaaaaatggtgatcggtaacaaaggtcagaagatcaaagtgatcggcactgaagctcgtgcggatatggaacgcctatttgataataaagttcaccttgaactgtgggtgaaagtcaaagctggctgggcagacgatgaacgtgcgttaagaagtttgggttatattgacgaataatgatcgaacagtggcaacgtggctttgtattacatcgcagagagtacagcgaaagcagtttactcgttgattttttcactgaaaatcacgggcgaattaccttacttgccaaaggggtaagacgaccacgttcgccattgaaatccgttcttcaaccctttacccctttattgctgaaatggacgggtaaaggtgatctcaaaacacttaccaaagctgaacctgcatctttaaccctcccgatgcaaacgctggcactgtatagcggtttttatgtcaatgaagtccttgcaagagttttggaaaatcacaccgcttaccctgaattatttcagcattatctacactgtatgacaaagttggcaagccagccaaacgagatcgagccgatcttacgcacctttgaatttcaaacacttaaagcgttaggttatggggtggatttttgccattgtgcagcaacaggtaagcctgtcgatccaaaaatgagctatcaatttagagaaaatgaaggctttattgcctctttattacaaaataactatacctttatcggcaaagatttattagcttttgcagaaatgaatttttcagagaaagaaaccttacagtcagcaaaacgtttcacccgtattgctttaaagccttatttgggatcagcaccgctgaaaagccgagagctgtttcagtctgttttacccaatagattaaaagggtaggtcgggcatttatgcccgacctacttggagattcctttcttaatcatctcttcaaaaaacgggtagtcaactaaaaacgcatcgtgtccaaagtcggaatgaaattcataaaaatcgacggcaatgcctgcattttctaaacgttgtttgcttttgtgtaggtcaatctgtttaaacagttgatcgctcgttacgccgacaagggtgtaattcgctttaatgcgactgagtgcttcttgctcgtttgcataggttaaagcaggatcatagagatctaaggctcttaacaggcgtaagtaactattagcgtcaaagcgatctagaaatttgagcccttgataacttaaataagattctacttggaagtgatcaccccaaatcgttcccgtctgtttcacttctctcccaaaggctttggcaagttgtacatcggtgcggtaggtgagcataccgagcattcgggcaatttttaagccgttatctgggggcgtactgccataataatcgccgttgttaaaatggggatcgtttattaccgcttgtcgcataacgtgattgaagccgattgcttctgaactcaaggtaagcgaagaacagagattgactacatttttcacttgttccggataatcaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccactgtgtcgcttgcattccaccaaaagagccacccacgaccgcttgtagccgagtaataccgagtttatcgatcaaggctttttgcaccttcacaatatcttgcacggtgataacgggaaattgactgccgtagggtttattcgtatttggattgatagacgaagggcctgtcgtacctttgcaaccgccaagcacattcgagcagataaaaaagtatttatcggtatcaaaagctaatcctgcaccgataaaatcttgccaccagcctttatccgcaggcggtgcataatagggttcggcgtcacccgttaaagcgtgacacaacaatacagcattgcttttttccgcattcaatgtgccataggtttggtaagtgacattgataggcgaaagtgttccgcctaaagcaagctcaaggggaatatcatcaaaaagagtaatctgctgtgccataaaaatccttgcaaaaaacggtaaaaaagcgaccgcttgtctttgaatggtttcaagtttacgaataggaaatcgtttcgtcaagaaattttagacatctaaacgtctagatttttaaatggctaaattaattattgtattactatgggcacttatgctgtcagaaaatcattttgggatatagaattactcatccttaggaataaccacagcaggatccactttcccttcaaaaccatcaatcaatttttttagcccataatcttccttgtctgaatgaggactaaataaatcgacttctgtattcaatttcggattactaattcccacccattttgcaatgccatcggtaaagtttaagccagatttcatcgctttatagacttttctatcggtatcatcactagatattttaaagagcggaacatcaaagtgtagcttacttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagtgtagcttacttttgccactgctgttgtggattgcaatgtcattttcagtgatatggtgagctaaaccgtgatcggcaaaatagaccaccgaaaacgagcggttagattgttgctcatttttgcgaagggtttcatataagcgttttaacacttcgtcggtttttttgatggacgatgcatagcagtttacgttgaaatactttttgcctattttttcatcatcaaacattttagggtaatcagttaaacgatcacagctgatggggtgtgaaccgtataaatgcaccacaacaaaacgtttgctatgagttttttgctcaataatgtgttcaaatttaggcaataaatcaaagtcactgatattttgatggaaagagtcccccgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccccgattttaagaataatttttcgtcacttttgttagcaagggaagaaacaggtgtatcaaaagtaccaagataaccttggtttgatagccagtaggttttaattcctgcggatttaatcaaatcgatcataccaaggctgtattccccttcccacttttcagtatcaggcttagtgagcattaattttaatgaagcaatggtatttgttccaccagcggtcagcccatcaattaaaatgccgttggcactgctcataaacggcgtattttcagcagggtagccataggcgtggtgataatcttttctggcactttcgccgatcactaaaatgtaatcatcgtaacggctttccgcattgagttgcgacgttctccattcactttgaatggacatactattcaagcggtctaattctgcttttactttactaattgcactacttccttcttgtagaaatttgaagggcggagtagagataaaaactaatgcaatccctaaggcaagaaaggttttatttttgtggaactgaatttgccatttttggctaataaaacgaaaacctaacagtaatataaaaatgccagtacaagcaacaaagttaatcagggggatttggctgaaaaactctttgctttcttgtatatctgtggcaaaaaccgaagcaacgtattggtacgatggtgggccaaaggtcaagccaactggcgtgtaaagggcatataaagtgacaatcggtaaaagcagataaaagaacgcttttttagaggcattagcaaataaaataacgagaaccagcagtagcacattgctgatttcaggagtaggaaaaaagcctgagccaagtaacattaggtaacttgctaaataagataaaccaaaactaatgagagtagcgagtatctttgttatattcattatgagcaaaacgaaaataaagggatagcgattttaccgaaaataaagtggaaattctatccgcttgcctactttgatctgttcttaagataatctataatatttcgatttttttccccaaccgttacacagaggtcaaaatgagcaatcctatttataaacgtattttgttaaagttaagtggtgaagcattacaaggtgaagaaggttttggtattgacccatctatcttagatagaatggcattagagatcaaagaattgcttgcaatgggtgtcgaagtcggcgtagttcttgggggcggtaacttattccgtggtgctaaacttgctaaagcgggtatgaaccgtgttgtcggcgaccatatgggtatgcttgcaaccgtaatgaacggtttagcaatgcgtgacgccttacaccgtgctgatgtcaatgcaaaattaatgtctgcattccagttaaacggtatttgtgatacttacaactggtcggaagctatcaaaatgttacgcgaaaaacgtgtcgtgattttctcagcaggtacaggtagcccgttctttactacagactctgcagcttgcttgcgtggtattgaaattgaagctgatgttgtcttaaaagcaactaaagtagatggtgtgtatgattgcgatcctgcaaaaaatccagatgcaaaactttatcaacatttaagctatgctgaagttattgaaaaagaattgcaagtgatggatttagctgcattcactcttgcccgtgaccataatatgccaattcgtgtatttaatatgggtaaagctggtgcgttgaaacaagttgtgacgggtacaacggaaggtacgacgattgcttaattaacgctattcaacgaattaatccaacttaactatttatttaagttggattttttattctttactttgccatttcaaattcaattaacatcatgagaatatggattactttaatatgtatctcttgaatacgatcagcataacgaaaatgaggtacacgaatctcaatatcagctagttctgctatttttcctccatccttgcctgtcattgcaataattttcattcctttggcttttgcagctatgattgcattaataacatttttagaatttcctgatgttgataagcaaaacaagatatctcctttttgtccgattgcctcaacataacgagaaaagacatattcatatccaaagtcattgcttacgcagcttaaatggcttggatctgagattgctatggctggatatccaggcctattttcacgataacgtccagttaactcttcagcaaaatgcatagcatcacagtgtgagccaccattcccacaggaaagtatttttcccccgttcttaaaactatcagtaatcagtaaagctgcttcttgaattagtttaagattatgttggtcattaataaagtcatttaatacttgttgcgcttcttgtaattctattaaaatttgttgttggtacataaggattccctcttgtgatgagttaagtcaaataagtctaccacaaaccctataaacttagtactaggaaaatagaatgaaattgggtaaaatcaataggtttatgttattcaatcaaaggaaaatactatgattaatgaaattaagaaagatactcaagaacgaatggaaaaaagccttgaggccttaaaaggacatatttctaaaatccgtacaggtagagctcagcctagtttattagatgctattcaagtggaatattacgggtccgcaacaccattacgtcaattagctaatgttgtcgcagaagatgctcgtacattagcagtcactgtatttgatcgttcgttgattagtgcggtagaaaaggcgattttaacttcggatttagggttaaatccttcttcggctggaactactattcgtgttcctcttcctccattaacggaagaacgtcgtcgagatttaattaaaattgtaaaaggtgagggagaacaaggtaaagtttcaattagaaatattcgccgtgatgcaaatgataaaattaaaactttagagaaagaaaaacagattagtgagaatgatgagcgtaaagctcaagatgatatccaaaagattacagatatttatatcaaaaaagtggatgagattttagcagacaaagagaaagaattaatggatttttaacatatgaattgggcggaaattttccgctcaatttattctaactggtagaagagatttaagatgttgttatgaatttctttattggtttccaatgtctacatcctatataaatagagtaaaaccgtttcattttaagagaaaaaatgatagaaaaaacctttattgtggggaaagatgcagcccttgaagaaagcatcgaaagattccagactaagttgaaagaattaggatttaatattgaggaggcttcttggcttaatcctgtaccaaatgtatggtcagtacatattcgtgatgttgattgtccacaatgtttttcaaatggtaaaggagcaagtaagaaagcagctcttgcttccgcattgggggagtattttgagcgtttatcgactaattatttttgggctgatttttatttaggaagggaaattgctgaaggtgaatttgttcactatccaaatgaaaaatggtttcctattgaaaatgaaacggaattacctgaaggaatattggatccatttctacacgactattttaatccaaatggagaattgacaccagaatttctggtagatctacagtctagcaattcagaacgaggaatagttgcattaccttatattcgtcagtctgatggtcatactgtatatattccacaaagcattattggaaatttatttgtatctaacgggatgtcagctggcaacactaagaatgaagccagagtgcagggactatcggaagtatttgaacgctttatcaaaaatcgtattatcactgaggcaatcagcttgcctgaaattccgcagtgtattattgatggttatccgacgattaaacgttcgattgagcaattggagcaagaagggtttccgattctctgctatgatgcttcattaggtggcgaatttccagttatctgtgtagttttacttaatcctaggaatggtacgtgttttgcttcttttggtgctcatcctaatttccaagtcgcatttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaatgcaggagcggtagcataacctggaactaaaaatgcgagtggttggaagaaaagcattaataagaacaacacgccaacaacgaccgcagtcaaacctgttttaccaccaacagctgttcctgctgctgattcaatatatactgctgcaggcgcggtaccaaataaacctgaaagtacactacttaatgaatctgaagtaagtgctttatcaccgttgataatttgcccatctttatctagtaaatttgcttgacctgctacagcacgaatggtacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgcgtcaaaaatggcagtcattactaaggcaaagaccacaggtaaaatggctgcattcaatgcaccgacaatatctaaatttaagaattgagaattttcaccaaaggtcggtaatttgaatacttcaccgccaaattttacattcggatcgaaaattaaaccgatgattgtaattgcaatgataacccaaagaatagaacctttaatttgtaaacgctctaaaccaatgatagcagctaaaccaactaaagacatcattacaggaaaagaagtgaactcacccatttttaccggtaaacccgcttggttgctgacaactaaaccaacgccacttgctgcaatcaataaaaggaataagccgattccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactaaaccaacgccacttgctgcaatcaataaaaggaataagccgattccaattccagcgccgtgagcaatactagatggcagattacgcaaaatccacgcacggatacctgttacagaaacaatggtaaataaaacacccataaggaagattgcacctaatgcaacaggaatactaatgccttgacctagcactaaactgaatgcagtaaaagctgttaatgagatagcacaaccaatcgccattggagcatttgcccataagccaatgaggattgaacctaaaccagcaaccaaacaggttgcaataaatactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatagtatgattaaagggtcgaggattctacacaaagataaaccaaaaagcaatcgtttgcgctaccagtgttgaaaatatttaggttgagtgctataagaaacatataggttatctaatgtatttaaagtgcaaaaataagagcattagcgtttattaatatctcctaataagcctgcataatggatcgttttagggctcgattctaatgcaattttgagagccattgtcaatggaacagaaagtagcattcctactgtaccgagtaaccatccccagaaaagtagtgacaagaatacaatgagagttgagagaccaagggttctccccatcattctaggttctagaatattgctaattaccatattgattgcaatgataccgacggatactcccaatccaacagaaaaaccattcaatagaaatgcttgtacagcaataggtacaccagcaatgattgaacctatgtttggaatatagttgagtaggaagcttaatgtgccccataatacagcatattgtacatcagctatttcaagtaacacccaaatagatatccctgtaagcaggcttacaatcgtttttatgccaagatagctaataactccctgtaatactcggttgatatggctttcttccgattccacatctttattgcctctaagagccacgataagtttatgtttagcggttggggcctcaaataacatgaacacaacgactaataagagtacaaaaatatttgtaacaacgcctgagaagctaagtaataagcgactaacaaagttcataataatgcttgggtctagctgttcttggatctgttcacgagatattgaaaccgggatattccagttatcaacaaggagcattgcggcagcaatacgttcagatagaagaattttgtattgtggaattgatgctgtaaattcttgtactgtactgttgattagtcctgccagaaaaaagaatccaagtaaaaataaaataaagagtatagtgattgccagccacaaagggactttatgagaggttagatatttgataataggagaacaaataattgcaataaaaagagataataagaaaggaataacgatctcaacggataatttaatacccgccaaaataattacaagagcagcagtagctaccagaatctgagttaaagacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgagttaaagaagaattttgttccatatctacgagaatatattgctatgtgattgagtgatggtatatcaaatgtttgtatttttagatccaactatgttaatagctagtgattacttctttcaacaactccaccgccaagaacgctaagctaaaacgctgttcatcagccactgcccagaattgtagtgcgttttcatttttattgagtagttggctaatttgtaagagatttacctcttcatcttcgccatttttaacaggagtaaccacattgtcagagttaaattttacccacgcttgttgttgccactgctcacttaatgcggtggcatctaaagcatactcagattgcacgctgatcatctgtgaaatgccatagaaaacaggcacttgcacggaatggaaagtcacactagcggttagatttggcagaacttttgcaagttgtaactcgaaggcacgagagaacggcaggtgtttttcatcaccttgcacatttgcaggcacggcatcaaacgccacacgtggtttttcatcatcaaggggaataccgtttaacaactgggcggtttgtcctgctaactcacgcactttttcatcaccaaaatacgccgatggcaacagtgatgtgacaaaaatatgttgaataggctggtccaacaacggttttaaggcaagtgctaattggctgatttgtggatttgctaaagcaacaatatttcgctcacgcatattagcgatcatttcgttgtttacacttggcacaatcacaggcacattgccgattaatgcagaaatgccgtaaagatctaaaatcacacagcctgcttgtaccgcttgagccagcaattctgcatttgccattttgcctgcaaagagaacgtgactaaattgcgaccaatcgacatcttcaacagcgatttgctcaacagcttttgcaccgaaacgcagagaatgttcttcaccaaaactttccaattcaacggctgaaatttgttcaaaatctaaactactttgttctaaggcttctaataatttctcggctaataaaaaatctgctgcaattgctaaacgaatgtttgccattttgtttctctctcgtcaaaataaagactaattttactcttttttatcgcgattgcgaaaggaaaaatagacctcagatattgatttttgaatctcattatatgtcgtgaatctttgatatgtatcattatgaaatttatcattatttcaaccacttatcttcatcttgcttacgctcaaattccgcttcaaaagtcgtattattttgagaggaagtcctgttcattgaaccaaaggacataaatttcacacggcttgcaaagagtttcataaaaattgcctgtagcaattggcgagtgatgggcaaaagaagtagcaaagcgacaatatcacttagaaaacctggaataatcaacaatacccctgcgattgcaaaaaagatcgaagaggtgaccgcttgtgccgggatctttccttgtgcgatctcttggcggatctgcattatggtcattattcctcttaatttcactaaccacaaaccgaccgcagaaatagtgatcattaataaaatcaagggtaaaaccccgatagcagagccgacgcttactaacagagagatttcaatgtagatgtataaaaatagcccagctaaaaagagaagtaatggcatagaaatttccttatagaagttaatcgccgattagatagtgataatttgaacattttcaaccctagccccccacaactcaagtaaatttaatctatttaaagctaatcgtttgcttttttcatctagagataaaaaattcatttgttttatgcaaaaaatatgctatttatatagccattcagcttttattgataaatgaaaatgacattacgttctcttgttagcctgattattattaacctcgtggtgattattatcaccgcgggggttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcaccgcgggggttaagttggctcgcaattagaattgtataatgagatccacaaaccctcgctagttttagtgagggtttttttattgtataaaagccttaactaaatagcgacacaacattaaaaggtaatttatgaacggtgcaaatttggtcgttgagtgtttgaaagctcacggcgtcacttctctttttggctatccaggtggggcaattatgcctgtctatgatgcgatttacgattcaggtttagatcatctactttgccgcaacgagcaaggtgctgcaatggctgctatcggttatgctcgagcaacaggcaaaacaggcgtttgtattgcaacttcaggccccggtgcaaccaacctagtcacaggcttaggcgatgcgttaatggactctattcctatcgtggcaatcacagggcaagtggcttcagcctttatcggcacggacgctttccaagaagcagatgtattaggcttatcccttgcttgtaccaaacacagtttcatcgtgcaaaacattgatgaactacctgaaattatcgccaaagcattccaaattgcacaaagtggtcgccctggtcctgtgcttgttgatattcctaaagatgtgcaattcgccccgacatcactttcccctatcgagatcggaagagctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcccctatcgtctatgaaaaagtggcggctaaggcacaaaatccaaccgcacttacacaagccaaagccctgttagctcaggcaaaacgccctgtactttatgtcggaggtggtgtaggtatggcaggtggagtgcaagcggtcagatctttcctagaaattgccaatgtgccctctgtttccacattaaaaggtttaggcacaattccgccacaacacccactctatatgggaatgatcggtatgcacggcacaaaagcagcgaactatgcggtacaagaatgtgatttactcatcgcttgtggggcaagatttgacgaccgtgtaacaggcaaacttgataccttcgcaccgcacgctaaagttattcatattgatattgatgtagctgaaatcaacaagctacgcaaagcagatgtagcattgcaaggagatttaatcgaggcagtgaccgcacttacccaaccgttagagattgagagctggcgagctgatgtgcgtaaactgaaagcggattttgacttcagctatcaagaaaatgcaggcgaaggcgaaatcgacccttgggcgttgttacacactctttcacaacgtaaaccgcaaaatgcgattattactactgacgttggccagcaccaaatgtggtcagcacagcatatgcagcattatgctcctgaaaactacatcacttctgcagggtttggcacaatgggatttggcttgcctgctgcagtgggagcagtcaaagctcgcccaacagatccaaccattgtgattacaggggacggctcttttatgatgaacgtccaagaacttggctcaatcaaacgtggcaatttacctgtcaaaattctattgttggataaccaacgtttaggcatggtgcgtcaatggcaatcgctctttttccacggtcgccacagtcaaaccattttagatgacaacccagactttgtgatgctagctaacgcctttgacattccagcagaacgcattgaaaaagcaggggaagtttcagccgcattagaccgcttactcaacagcaaaggagcgtatttattgcacgtttgtatcccaaatgaagaaaatgtatggccgctcgttccgccaaatgcgtgtaatacagatatgttagatgaagacataggggtttaaggagaagaaaaatgcaacaatatcaatttgttatcaaagctaataaacgccctgaaacctttgagcgtttactcagagtgattcgccaccgtgggtttgaagtgctatcactcaatgcagaaaataatggttcggaaatcacattaaatatcactgttcagagtgaaagagcggtggaattattgtttaatcagttggtgaaattgccagatgtggtgactatttcatagttattctgaggagaaaactatgcaaatcttaaaacgctttttctgttactgcttgattttatgttttatgacagcttgtactaaaacagagtatcaagatgaaaataccaaaacagaaacaatccgagcattttttattgctgataataaattatatgttgtcggatatttgcatagttatcaatttgaaagcagtaacaaggagaatgctgattatcaagagcggaaaaccaccgaatttatccgtttgcttcaatctgaaaaaatgaaatctgttactaaagcagagattatttatatcaaaaatcaaatgaaaacacctgatattgagtctagggtaaaactcacttctttacataataagaaatcatcagaacagttttatgacatttatgggaagttggtcaaaattgaaaatcaagatgcagttctgaacaaagccaaattagaacagccactacaaacacaatttatagcatattcagaaaaaataactttagatagtgaagctactggaatggttcttgtttggggtataggaagcgtggttttcattcctctttacattatcttctcaccgcttgtattgataaataaaataatggattaacgtgatggaaaggaggaaattcgataaataacccatacaacaagcggtttgattcggcaaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagaatatagcaatgattaagcaaaaagtccccgtgggatttccacggggttatgaatgtgctttcaagtgattgtttatcatattactattagaaatagtacttcgcgccaatatttccttctttgtaataggatttcattgggttattccacaatctataataagctatgttagcgtaaatattgaggtttttagtaagataatagcccatacctaaactagttttaaattcatatcttggtaatctcattccatataatttagtttcagtgttagaaataatatattttccacttactatattatccatattgttcttattataaagataagaaatatctagatttatattaaatttttcagataatgattgatttaatcttaagcccaattcatatccataatgggttttatgatatttatcaatacttaatgctaaatcttctttttcattaatggaatcctgttttaaacggttaatatgtaacgcaacatatggattaaatcttaatttttcatattgtagatttaatccggtttcattataaaaagaataattttgtaattttaaatcagctttaattatctgtgtgccattaggcaataacaatgttctatctaattttcctttaatatcagtaaaactgatttggctgagataataccatttattccaatcatattttccgtataaggcgaaactgtgttgttttaaatctacttttccaacttgttgatctttattagataaaggagataatttttgatgaactcgttgcaatcccataccaaatgtaaaggcattaaattgcttatctataccaactaattgtgaatctgcactattttttaaatctgcaaatccaaaattatcattctgataaagttttaaactttgtgtagctaactgagtataaatgtgataaggcttaatatcttgaatatttgagaattgctgtttagcaatttgtctattcaaggttttaatactattcagtgctacttgatgtaccgctggatatatttcgccacttaaagaatctactgcggaagctaccgcttgtggtttagcattaataaaggataatgccgtacttctgaggtttccatttgtgtttcctgaatcactcgcactatctaaaataagatctaaacttctcgcagtataaacattctttaatgagctttcattggcagattttaatacaaattctgtatcatttcgtttataggttgcaataatttctttattattcccttcttttaatttaatttcttttaaatcaatataagggttagcacgatccgatattttgtaatctccattataattttgaataggattttgagactcaataatggtttttgtttgaggatctcttgaaaccacttcattaatattttcaacatcggctacaatacgagaattttgtaaattgacattgccttttactgttaatttagatttatctatatcaataaccgttctggcattatttgaagtagtataattaccctcaataattaacccctttccataaacctccaaggaacctttattatctacattttttactattttaacttctgtttgagagttatttaaatttttcgttaataatgttccctgtgactggatttctactgtggattgttttaattcatttccaattaccaaagttccgttttcgataactgtatttccactataagaatttgaaccagtaaaataaagtgttccagtaccttgttttttaaagccagcatcaccttgaatattattggaccaagtgtatttagtgcggtcggtatgatgtttataatctaattttgctacaacatgggttttattatcatcggttaaaagttttgtatcaaatctagctggtccgtttaatgctctatcttgatttaaaataccccaaccaacacgttcattcggttcttcggtcacatctgacgaatttaatttatttgcagtggataatatggtttgggtcactaaatgatgatccatccaatcaaatttttcccaaacattagccacggcagcagtaacaacaggtgtagcaaaagaagttccttctgttcgtacttgtttatcaaataaataccattcaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctatttggctcgcataatccataagcccattattttgtggatttaccgaggttacaacaatccagccttttcttgctccatctctaattaaaggaacgtgtccttctatggttgcatattcattctgtcctgtatttctttttttgccatcattgccagatgcccatacaaaaatactgtctttttctgccattgcagccaattgcttatataggtctaagcctgctaacttttcccatcctttttcttttacactatctctatgtggattattaccgtaagagttattaaatattctaaccttatgatcgtatgcttcattgtaatgctgattagatgcacttacagcttccatataagcggattttgcagtataagcataaagcgtagcatttttatttttctgatcgataacaccagcaaccatcgtaccatgagagcttttatgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgctgacgtatataaacccgcatttaaaactatacgacttagcccattctcaaatttaaaggctttgccaagatcatcacgtgtattaaaatccatatcaacaatcccaattctattagtaaattttgtttcttgggcggttttctggtaattatttttatctaatctctcaacttcaggattaacccaaggctgattatccacaggatttattgatgaattagattgcgtagaaggattattttctggagttgtagattctgaattattatttaaatttaaagtaacatcattattttctaccgaattatttccagatacattattttccgtatcagtatttttattatcatcactatttccagcagataaattattattttctggagttgttgtagttaaatcttgattgaaagaaggcgaatcctcggaactgttttctttgccggtttcattattttcttgatttatattttctccagaagaattatcattatgagtaatattatttgttggatcattattactcgatatttcattattagtcggttcattattagtcggttcattatttattggtatttcattactgttagtttgggtttctggagcagtttgaatttcagagctttgagattctttttcctcttcagccttttcttcggcttcaggctgttcttcaactttcggcaattcatcagcttgaggatcttcttctgcttgtgaattttcctctgtttgtggattttcctcttctctaggcggttgtttttcagtttctgtttgtggttgttcttgatgttctacttttggctcttctacgacttcttcttttctatcctcttttgctacttcttgcttatctgtcgtctctgctgtagcttgttcattgttagtattttccgtactaggtttatctgtagaatttggactgtccgaagttgttggatcgttcgaagttgtttgattgtctgaaatgattggttcatttgaagttgttgaactctcagcagaacttgggctgtcggccttaggctcatcagatggtttttgactatcagaagtcgctgaatttgaactatctgtaggcattgaattatctggagcagctggcagatttggagttatcgaagtatttgataaaacagaatcgttagatgtatttaaatgatgattagtattggaagaatgagacgtaagtgcattatgattgtctgtctgtctgtctgtctgtctgtctgtctgtctgtctgtctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgtctgtctgtctgtctgtctgtctgtctgtctgtctgtctgtcagggagtttattaaatccattatttgtagttccactactttcagcactaaaatggctacctatcgacgaattaactggattttgttctttattatgttggggagaatttccgccagtgccatctttcttacaagaagagagcaacacagcagaagataaaagcatagtagataatattgattttttgatgttcataatttgtatcccttatttaaaaaatttattttatgaaacttgggtggagtaatttctcgctttaatactctttatgaagatcgtaattaatttttatgtaggtgagcattaacggatagtgaagattactttgcaccagtccttatcagaactattttatctgaaaaattcatttttcaaaagataatgtgttattagttatttataacttttagaaataagagaaacaccagaaatagcgttgaaaaatccctatctccccaaatcttaactacacaattccccccttttccgctacaatcccaatgattttttgctatattttagagagatttagaatgtcaaatccaaaaagaaaaatactggtcacttgtgctttgccttatgctaacggtgcgatccatttagggcatatgcttgaacatattcaagcggatatttgggtgcgttttcagcgtatgcgtggcaacgaaattcactttgtctgtgctgatgatgctcacggcacgccgattatgttgaatgcggataaactcggtattacccctgaacagttaatcgaaaaagccaaagccgatcacattgcggattttgccggttttaatatcagtttcgataactaccattccacccacagcgaagaaaaccgtgaatacacttctgccatctataaaaaattaaaagcgaacggttttatcaagagtaaggtaatctcacagctatttgaccctgaaaaaaatatgttcttgcctgatcgctttgttaaaggtacttgtccgaaatgtaaagcggaagatcagtacggcgataactgtgaagtctgtgcttctacttatagcccgatggatttaatcaatccacgttcggtagtgtcaggctctacccctgtggtaaaacagtcggaacactttttctttgacctaccaagctttgaagaaatgctgaaagcgtggacacgttctggctcgcttcaacctgaaattgccaataaaatgcaagagtggtttgagagcggtttacagcaatgggacatcagccgtgatgcaccttactttggctttgaaattccagatagcgaaaacaaattcttctatgtttggcttgatgcccctatcggctatatggcttcgtttaaaaatctttgcgaccgcacgggcttgaactttgatgatttctggaaaaaagagagtgatgctgagttatatcattttatcggtaaagacattgtttacttccacagtctattctggcctgcgatgttagaaggaagcgaataccgcaaaccaacgaacgtttttgctcacggttatgtgacggtggacggacaaaaaatgtcaaaatcccgtggtactttcattcaagccagcacttatttaaaacatatcgatcctgaatgtttgcgttattactatgcggcgaaattgaatgatcgcattgaagatctcgatttcaatttagaagattttgtacaacgagtaaacagcgacatcgtcaataagttagttaatttggcttctcgtaccgcaggtttcatcacaaaacgctttgaaggcaaactcgcttcaacattagaaaatcaagcacttttcgatgaatttgttgcacaatcggagcagatcgccacttattttgaaacgcatgaatacaacaaagcgatccgtgagattatggcattaacggataaagccaataaatacattgacgacaaagccccttgggtaattgccaaagaagaaggcaaagacgctgaattacaagcggtctgttcaatgggcttagagctattccgtgtattaatgagctatctcaaaccagtattaccaaaactcgcagaacgtgccgaagcctttttacaaacggaactgcgttgggacaacatcggttcgccactatttgcccatagcattgcaccgtttaaatcgctcttctctcgcttagagaaaaaacagattgacgctgtgattgaagaaaccaaagcacttttcgccgaaagcgtaaaagcagaaactgcaaaaaaaggaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagaaatgaccgcttgtgaaaccaaagttgaaccgattgcctctgaaatcaccattgacgacttcgccaaactcgatctgcgtgtggcaaaagtattgaaatgtgaagccgtgccgaaatcggataaattgttacgttttgaacttgatttaggcgatcacactcgccaagtcttctctggtatcaaagcggcgtacagccaacctgaagagcttgaaggcagatttgtgattatgattgccaaccttgctccacgcaaaatgtcgtttggtatgtcggaaggaatgattttatctgctggcacaggcggtgcagatctctacttgctctctgccgatagcggcgtgacggctggtatgcaggtgaaataaatttacttagggtgggatttttcaccctgtcttaactcaataataaggacaacaaatgatccaacaaactctcgccattattaaacccgatgcgactaaacgtcatcttatcggtgaaattttaagttatatggaaaaaaatggcttagcgatcaaagcgttaaaaatgcttcacttaaccaaagaacaagcggaaggtttttatgcagaacatcaaggcaaagacttttttgatccgctcgtagcatttatgatttctgagcctatcgttgttgcggtgttagaaggtgaaaatgccgtggaaaactaccgcttgttaataggggcaaccaaacccgaagaacgtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgacattcctgcaatcattttggggcaaatgtaatttgctcttacaaccttatttataggggctgatgtaggttggtatactagctaatctaatacagccccaaaagttttgttaaaaagaagcactggttgggaagcttatgtgcatttagccaaattggggcttgggtttcttcttcggggtacttttttattggggctaatctacgtcagcccctaaagttttatggtaaaaggcttcaaattaccttttaaaatatgaataaaatgatctgaccttcaaaagttatacagctattcaaaggactgatttcgatattgtatcggacttagtccttttcgtttggggttttgtttttctgcgaagtaggtactgtgattgatgcgaaaatgattaaactcagttacatcagacttatcatagtttcggtagaaatcggtgtaaacaatactgccgggcttcacttgttcttgaatatcgaacctcttaagatgtagactgttttgcttgataagcaatcacagacgatggaaataataggctgcggtagctttatttacatttatcaactcagcagctgttcgagcagtgatatctgctacaaacagctcaataagtttattttgtttatactgacttagataacttttgctcatagggctatcttaacctaatagggattttagtcgttatctaggagagacctataaatttactaggaggaagtttctcaccctgccttaacttgaatataaggataaccaatgatctaaaaaactctcgccattattaaacccgaagtgtctagctccattctattaatgtaagcgacttacaccttcggcaaaaacaatctcaacaccaacagtgcgtacattacttttgctaaagcaaaggtcagggcgaataagatcacggcaagggattgttcccataggggaataggatcttcaaggctggtgtattcatcaaaagctaacatcaatgaaaatgaaaaaaggctgtaaatgaacattattacccctgagaaaaaggcaatttgaatgatgttacgttggtgatattgctgtttgtagctgactaatgcaaatagaaaagctgggacggtaaataagacaaaaacaaccaacattcccccttggctaaattcgctaaaaaggggtaatagggcagagccgagtaactgggtaagtagtggataaatccataaaatgtgtaggctagttttttgcattgaggtattctcttaataaaaataaggcggataaattgcgtgcttcggcaaaattagggtcggcaagcagttcgtcaattttgtttaatggataatagatgatgtcaagtggctctggttcatcgccttctagctgtgatggatagagatcttgagccacgaaaaggtgcattaagccgtacatatggctaggaccgctatacaatgaacgcagtggttcgattgtttttgctccaaagcctatttcttcttgtaattctcgatttgcactcagtacaggatcttctccactatctacaatgcctttagggaaggtgagttcatagcgttcaggccctacggcatattcttttaccaagatgagttgattttgatggatcggcacgaccattacggaagaacggcgttgtggggttaggcgttcgtaagtacgttctttgccatttgaaaaacgtaaatcgacggattgcacttcaaaaatgcgagttttggcaatcaccgaaacagatttgatttcaggcagttgttttgacataaaatttctcaacaagaatggatttgcgatattctagactattcattctcaaccaacaaccaaataaacactccaaagcaataatgcataacgaatagctttgcctaatacgatgaaacataggcttttccaaaaatcaaaacgtaaccaacctgcgacaccacaaaagagatcgcccacaataggtagccagctaaacagtaacacccaaacgccgtattgttggctaaatttaagtgcaaatcgaatacgttgattttgctgttcgtgatagtttgggggtggaaaaagttttgctagaaaataggttgttaggctacctaagctgttgcctaatgtggcactgataaacaatccatataaggaatggttgttcgcaaaggcttgtgtagcaaaggtgctgaagatgatttctgagttgctgggcagtagcgtagaacttaaaaaactgctggcaaacataattaaatattgattttctttgtcaaggaaaatcccaagtaaagcggtcaaataatcggacatttttgtaactgttctgttaaatttgtgttttgttaaattttaatcaatgttaaaacttgatgtggatcaagaaataattctactttattctgtttatgttgaaaatttatttgatgatcacttcaacaggtctataattctcaacaaattttgtaaattttcaaattttcatttaaggatagtgatgttttctccagcagagatggctaaaatcgccgaagatggtgcggtttataaagcgacaaaaaatcaattttattctttcatttcagcaattaccgcaggtgcttatatttcaattgcctttgtgttttatgcaacaacacaagtcggtgcaggggaactgccgtggggcgttgcaaaactgatcggcggtgttgtgttctctcttggcattataatgtgtgttgttttcggggctgaactttttacttctacgacaatgaccattgtagctaaagcaagtaagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttggctcagatgtttaaaaactggtttgttgtttacggcggtaatttcatcggtgcgacctttattgtgctgttagtgtggtttagcggtgaaattatggctgcaaatgggcagtggggcttgactattttaaaaacagtccaacataagatccatcatacttggattgaagcattcagcttggggattttctgtaatctgatggtctgtattgcggtatggatggcgtatgcaggtaagagcctgacggataaagcgttcattatgattttgccgatagcaatgtttgtggcatctggatttgaacactgtgtggcgaatatgtttatgatcccaatgggcgtgttaattcacggctctgcaagccctgaattttggacagcgataggggttgatcctagtcaattcgctgatttaacaatggcaaattttgtggtgaaaaatttaattccagcgaccttaggtaacattgttggtggtgcatttttcatcggtatggtgcagtggtttttgcatctaaaaaaacattaattcaaaacttgtaagcggtcacttttcgcagtgtttttgcaaaatcgcaccgcttgcgttccaatttattacattaactaacgaggacttaaaatgactcaactaaccgaagctcaaaagaaagcgtgggaaggttttgcaccaggtgaatggcaaactgatgtaaacgtgcgtgactttatccaaaaaaactatacgccgtatgaaggtgatgaatctttcttagcagatgcaaccgaagcaactacaacgctttgggcagatgtaatggaaaaaatcaaagtggaaaacaaaacccacgaaccgtatgacattgattgcgatattccatcaaccatcacttcacacgcaccaggttatatcaacaaagatttagagaaaatcgtaggtcttcaaacagatgcaccattaaaacgtgcaattatgccgtttggcggtatcaatatggtgaaaggctcttgtaaagtttatcgccgtgaattaaatccagaagtagagaaaatctttactgaatatcgtaaaacccacaaccaaggtgtattcgatgtttatactccagacattttacgttgccgtaaatcaggcgtaattacaggtcttcctgatgcttacggtcgtggtcgtattatcggtgactatcgtcgtatggctctttacggtgctgacttcttaatgaaagataaagtaaaacagtttacctctttacaagagaagttagagcgtggcgaagatattcaagcgacaatccaattacgcgaagaaattgcagaacaacaccgtgctttaggcaaaatgaaagaaatggcagcatcttatggctttgacatttcaaacccagcaactaacgcacaagaagcggtacaatgggtttactttgcttaccttgcagcagtgaaatcacaaaacggtgcagcaatgtctttcggtcgtgtttcaaccttcttagatatttatattgaacgtgacctaaaagcaggcaaaatcactgaaaaagaagctcaagaattaatggatcacttagtaatgaaactccgtatggttcgtttcttacgtaccccagagtacgatcaattattctcaggcgacccaatgtgggcaacagaaactttcgcaggtatgggcttagatggtcgtacattagtaaccaaaaacagcttccgtctattacacaccctttacacaatgggtccatcaccggaaccaaacttaacaatcctttggtctgaaagtttaccggacggtttcaaacgctatgcagcgaaagtgtctatcgaaacttcatctgttcagtacgaaaatgacgacttaatgcgtccagatttccaaaacgatgactatgcgattgcctgctgtgtaagcccgatgatcgtaggtaaaatgatgcagttcttcggtgctcgtgcaaacttagcgaaaaccttattatacgcaatcaatggcggtgtggacgagaaatcaggtgaccaagttggaccgaaaactgagccaattatgtctgaatacttagattacgatgatgtaatgacccgtttagacagctttatggactggttagcgaaacaatatgtgactgcgttaaacatcattcactttatgcacgacaaatatgcttatgaagcagcattaatggcgttgcacgatcgtgatgtattccgcacaatggcgtgtggtatcgcaggcctttctgttgcagcagactcactctctgcaatcaaatatgcgaaagtaaaaccaatccgtggcgacatcgaaatcaaaaataaagcaggcgaagtggttggcgtagcgaaaaacgtagcacttgactttgaaattgaaggtgaatacccacaattcggtaacaacgataaccgtgtagatgacattgcagttgatttagttgaacgctttatgaagaaaattcagaagctcaaaacataccgtaatgcaacaccaacacagtctgtattaaccattacttcaaacgtggtttacggtaagaaaacaggtaacaccccagacggtcgtcgttcaggtgcgccattcggaccaggtgcaaacccaatgcacggacgtgaccaaaaaggtgcggtagcgtcattgacttctgtggcgaaattaccatttgcttacgcgaaagatggtatctcttataccttctcaatcgtaccaaatgcgttaggtaaagatcttgaatctcaaaaacgtaaccttgcaggcttaatggacggttacttccaccacgaatcaaccatcgaaggtggccagcacttaaacgtaaacgtaatgaaccgtgaaatgttattagatgcgatggaaaacccagagaagtatccacaattaacaatccgtgtttcaggctacgcagtgcgtttcaactctttaactaaagagcaacaaatggacgtaattactcgtactttcacacagtcgatgtaatttagtttaaactaattaagcggtcagattttgcaaaacttttgcagaaactgaccgcttattgtatcttacgcattaattgcgattagcagaaatgtttaaggacatttgtcctaatcgtactttatttaaaggaaaaagaatgactgttttagcacgttatcactcttacgaatcttgtggcacagtagatgggcctgggattcgttttattttgtttttacaaggctgtttaatgcgttgtaaatattgccacaaccgtgacacttgggatcttgaaggtgggaaagagatctccgtagaagatctaatgaaggaagttgtgacgtataaacattttatgagagcaacgggcgggggagtaacagcatcaggtggcgaagccgtgttacaaatggaatttgtgcgtgattggtttcgtgcttgtaaagctgagggtattgatacttgtttagatacaaatggttttgtacggaattattcagagctagtcgatgaaatgctagatgtaaccgatctcgttatgcttgatttaaaacagctgaacgaagaaattcataaagattttatcggtgtctctaataaacgtaccttagacttcgctcgttatttgcataaacgtaatcaacgtacttggatccgctatgtggttgtaccaggttatacggatgccgatgaagatattcatttattgggtcagtttattcaaggtatggacaacatagaaaaagtcgaacttctgccatatcaccgtttaggcgcacataaatggaaaaccttagggttagaatatgaattggaagatgtgatgccaccgacgaaagaatcgttagagcatattaaaggtattattgaaagctatgggcatacggtgaagtattagcgcttagatgattcgaccctatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatttattatatatgctataaacactttaataatcagctatatatttagatatttgccttctggtatgggatctaaaggaggagaaatatcaatttctgaatcttcaagtggtttttctgcttctttcatattctcttcatttgactgtgttaaaggcttatcttgtactctaggcattattgaagagtctaagttctgtttgatatcattagatactttgcttgagtccaccacaggatctattgattcttcatgtactcctatattattttctatattttgtggtttttgtgtctctaaaactctagggatgtttgcaatgaagattttttcttctttattgacaagtttacgcccaatttctacacgaggatctagccatactgctactacagcatcattaaattctttgttaaattcttcaggaataacaatattatttaatatgaaatatcctttattttctaaagcaatgtaactgagagaatcatctttcttgatattaggtaaaattttacgcaaacgatcaaccacattatcttgattttgcagagtgatgcctaaattagaccaagatctagctaaagaaattgcaaaatcacgcccttcaacgggcttttgatattttagagtcagcatcaatgggcgtgtgctattagtataactgcctgtttcagagaataatgaaatattatagattttaaatggtccccagatatagtctacatcattgatctttagccatttggcagagagggaggaattaaacagcaaagtagatatcaaaaaaaaggttaagcgatacataaagtagtatttccattaaaaaacagatttatttctgattataacgttaaatccatgattaagacatcctattatttatcatagaaaataaattataatcctataaaaatggcgtgaatggatcctaaatattgttggaaacttattgcgttttattgaaattgagcaatctagtctattgaactgtcaataactagattgcttagttacgactagccagctacccacaataatatagcgagaatttgaggcaagataattcgacaaaacatcactaatggatataccgtcgcataagagagtgctgctgcaccattaccctctttaataccatttgcaaatgccaaagccggtggatccgtcattgaacctgcaagcaatccacataggctcagataatttaatttaccataaatacgagcaaccagccctgtaacaattaatggaacaaaagtaattattgcaccatagccaatccacgctagaccatcattacttaataaagtattcaggaagtttccaccagctttccaacccacaaccgcaaggaaaagcacgataccaatttctcttaatgccaagtttgcacttggtggcataaaccaatagagttttttgatacttcctattcttgctaaaattaatgcaacgactaaaggaccgccagctaaccctaattttaatgcaacggggaaacctggcagataaattggaatagagcctagtaacacccctaaaccaaccccgatgaagataggcaacatttgtacttgttgtaatttttgttgagcgttaccgataatcgccatcacagcctcaatatcttcttggcgaccaaccaagttcaacacgtcaccaaattgcaatgtcatttgcccgttaggaactaactcaacccccgcacggtttaagcgagaaatcactacatcgtatttcccttttaacatcaattggcgaatttgtttcccaaatactttttcattggtaacgacagcacgttctgtgcggtacattgtgccttttgtcgaaagtgaaacattcacttcttcaccaagaatgagttgcattttatgcaacgcagtttttgttcccacaagatgcagaatatcgcctatttggatttgggtatgcactttaggcacaaacaactcatcattacgcttaatacgagaataaaccacttcgtgcagttcaaaatcaggaaactcttgaagcatcaacccattcaaatttggatttgtaatacgaacgttcatcgtacttaatccatcttttttattgttggttgcagaatcaaactcatcagcttctttatccacattaattttgaaaataatacggataagccacatcgctaatagaatcccgataatcccgaaaggataggcaattgcgtaccccatacccatcacagctgtaatggactcaccgcctaattccgtcaggatttgttgtccagcacctaatgatggtgtattagttaccgcaccagagaaaatacccaatatcacaggaagaggaacatcaaatattttgtgtaataaaatcactaaaataccgcttatcccaacaatcatcacagcaaaagcattgagctttaatcctgattggcgtaatgaagcaaagaaacccggaccaacttgaataccaatggtataaacaaagagaatcagaccaaactcttgaataaagtgcaaggtatgaccatcaagtttgacaccatattgcgtcataaaatgggaaaccagtatcccaccaaataacacaccgccaataccaaggcttacgccccgcaccttaatatgccctatccatagtccaatgacagcaactaaggataataggctcactgttaatgcaatttcgctcataaaagcctcacataaaaataaaattgctataattttaccaaaatttacatataaaaaatcagatctaactcaaaaaaactacaataaatatctgtttaaaaagacatttatcgcttgtatcattttttgtctatataaattcgctggaattacctttgaatttgaaagctctttacgtacagctttcatgttagccttcttctcatctatcggcttatccgcagattttccccgtttgaaacaaggtggaatcccacttgtcattttcctcgttatcgtgagtatatttatccttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttgttcaaaatggtgttggcgttggtttagctatgctacttggtattgatccacttgttggtttaattataggttctattactttaactggcggacacggcacaggtgcaacttgggcaacggtttttgcagagaaacatgggcttgcaggtgcaatggaaatggcaatggcatctgctacatttggtttagtggctggaggtttagtcggtggtccattagctcgacgtcttatcaacaaaatgaaaattaccccatctaaacacaatgtaaaagttgaaagcgtagaagcaaaatatgctgacgatacatttgaagatgctgacaatgtacgcttaatcacagcaacatcaacgatcgaaacaatggcattatttgcagcgtgtctagcattctcatcagttatggttaaagtattccctgattcaggtttaccgcagttcgtatgggccttaggttttggtgtggtattaagaaacgtattaacgttagtgtttaaatttgatatgtttgaccgtgctattgacgtatttggtaacgcatcattaagcttattcttagcaattgcattaatgagcattaaactttgggaattagcagaccttgctggctcaatgttacctatccttattgctcaaaccatagttatggtactttatgcatattttgtgacctttagagtaatgggaagtaattatgatgcagccattctcgcagcaggtcacagtggttttggcttaggtgcaactgcaactgcggtcgcgaacatgcaatctgtcacagaaacttttggaccatcacataaagcattcttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtggttaacttaggtgtaattacagcatttatgaattatttaactagctaaaatagcatagaaatcagagaggttgctaaaattatatagcaacctttgtagtcatgattgttagtctattatcaataaagagccagcaattagattatttatggaaaaaacttaatagaggctctgggttctgaatatactcagatagttcttttttactaggataaccaatataaggaatttgtcctagtaatggagcattgatttttttgctaaggagttcaattaattcagcgtagtgacgtagcccaggatttactcgatttgcaatccatccgataagattaaccccactttgttgaatcgcatccgctgttaaaagtgcatggttaacgcaaccctcttttattcccacaacaagtacgactggcattctatttttcttaacccaatcagcaaaacttaggtctttattaataggtgttaaccagccataagtgccttcaacaagaacatttgcatattgtcggtgtaaacgttgaagatcgtgatccagtttattaacagaaatatggcgtactgcgtctagcgctgcaaatactggcgtactagaatggataaaagaatagctattaatttctctatattttacaggaaaagggcagctgttctgtataatgaggacatcactattgtcttcacaggcataatcatcttgattgggttctgtgggtaaagaatcatcgccaccacacgcaataggcttataaccgacaatgggaatttcatatttagatattgtttgtaatagagcccttgtaacgatagtttttcctacatttgtatctgtgcctgtaataaataaacaagacattgtattttcctgttaatgataagttaaaaaattttttcaaattctaatctgaaattaaaattaatataatgttttcgatcaaattttctgataataaagacaatatgttctaagaaaaatgtagttaaagagaatttaagaggggattccctactcttaaattcaataatatatgaatactaggattttagtaaaccagaggagccttccgaataatctttaggttgatcttcatctgtttgaggtttattttcaattttaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattttcaattttaggctgttggaaaaactcaatttttgcagaatcggatggtaataatgattctgaaccttttgctaaatgggtatagagtttcttatagtcttcagcaagagtcgcaagcaatgttgcagattgctcaaagtgttgctctaattgctgtttttgctcgtccaattttttggtagtttcttttaaatcggcttcaagcttgagttgttttttgacattactatttgttgctctcacaacaacatagctaataatacaaccaacaataaatgctgcaataattgcagtccacacgttacctgaccattgttccatatgcactccttaagtggattgagtaaatgtcattaatttttatcatgttatttacaggatgaaaaggaaaagaaattcattttttgaaactatccacaaaaataaattttttatcaaaaatggttagatttttctcaaggaaatctgtataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgtatggtattcccgccatataagtttggtctgaataggactcgaaggggtcagattctaccgtattaataggtaatatccattaggatattgggtttaaactttaaattttggtatttaattaatgaaaacttttgtagcaaaaccagaaacagttaaacgtgactggtatgtagtagatgcgacaggtaaaactttaggtcgtttagctactgaattagcacatcgtcttcgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccacacgttgatacaggtgattacatcatcgttatcaatgcggaaaaagtagcggtaacaggcaaaaaagaaactgataaaatctattactggcatactggctatgtaggtggcattaaagatgcaaccttcaaagaaatgattgctcgtcgtccagaagcagtgattgaaattgcggttaaaggtatgttgccaaaaggtccattaggccgtgcaatgttccgtaaattaaaagtgtatgcaggtaacgaacacaaccacgcagcacaacaaccacaagttttagatatctaatcacggagcataaaaatgacagcagcaaatcaaaactacggcacaggtcgccgcaaaagctcttcagctcgtgtatttatcaaaccgggcaatggtaacatcaccattaaccaacgttctttagaagtttacttcggtcgcgaaacagctcgcatgatcgttcgtcaaccattagaattagttgagttaacagataaattagacttatacatcactgttaaaggtggtggtatttctggtcaagcaggtgcaatccgtcacggtattactcgtgcattgatcgaatacgacgaaactttacgtccagcgttacgtgctgcgggctttgttacccgtgatgctcgtcgtgttgaacgtaaaaaagtgggtttacacaaagcacgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgggtttacacaaagcacgtcgtcgtccacaatactcaaaacgttagtattacaattttatatatcctctctattaagagaggatattttctatgggctctttttagtatgatgtatctgtttagagcatagcatatatagatatagtgttatgtttagacactactagagattgataagattagcaacaatatattgtcaatcttctcccgtcattcctgattaaagctcaattcttcaatcgcctttaaacatttttgttttctattctctgtttcttgtatctttattgagagcatatgcctatactcagggtaatggtaattttgttcaatgagccatgagagtttttcattcaatgcacgcaacgctttatagtattcatgtaacttctgtttctttgataatgtatgaatactcttagtaaatttatattgagagaaaataggggaatctgactttttatccttgaggtgaatacttttttgtagagcatcatattgttcaattaaacgttgagtataaacttcagttatttcaggggaagttgactgctcaatatgtgaacatgtttctagtatttcttgtatgaattctttgacggagccatgagtaagtttaaagcagtggctatagatagagatttgcagagacaagatgggagaaaagtcgtttaattttgtaatgattgtatctgtaaaattacccattttttattctctgtattaagcgtatagatattttaatgtatgtacatctcttttcaaatttatttttgataaaaataatctttctatttttttctaaaaatgtgatgaaactcacatttttagaaaaaaggttataaatctttatttgctatgagttttttatttttaaatcatatagttatgtgatttattgcaataggagcaatattttaaaaaattatctctgaatacttgttttggggtggggatttattaacttattgattttaaagaaaatgtttttttgtttttttttatgtaagatattgacactactctacaaatttgcaatcatacgcacgcaatcggcatttaccaaacttacatgggaaggtaatggcagatatggatcggttactcttataccttaataagagtaatcttagctaaactaaaaacttaaggtgaacattatgaaaaaaacactagtagcgttagcagtagcggcatttgcagcatcagcatcagctgtaacagtttatgaaaatgaaggtacaaaagttgattttgatggtcaattgcgtcttcttttagaagaacaagccacaaaagagaaaggtcaatcttcaacaggtggtcacactaacttaaagaataatggttctcgtttcggtatttctatcaaacataatatcaatgagaatctctacggttttggtcgttatgagactcgccttggccgtaattctaaaaatgatgcaggatggggggatgttacaacagaagaggcttacgtcggtttaggcggctatggtcatgaaatttcttttggtaaacaagctgtaatcggtgatagcattggtcaagctggttttgataaagtatacgatgttggtactggtggaattaaatattcagcaaacaacacaaacaaaaaaggttttgatatccttacttcagattctgattcagcaattaactatacctatacaggcattgaaggtttgacgttaggtgctaactataatgttgcaaatgagcgtgataagaagacgggagaagtaaatgtaggttctactaaatctggctttggtttaggtgctaaatacacagctaagattgcggaaagtcaatctgtaactgtggcagcaggttatactcatgatgactataaatctggatctgttaataagaaagacaaagatggtgtatactttggtcttaaatatgtcaacgctccatttactgtagctgttgatggtggtcatggtgttgaaaaaacaggtaatgttaaagagaaaattgacttcgtaagaactggcgcaagatttgatgttactccaaaatctggcgtgtatggaaactactcttatggtacttacaaagataaagcttacaaagcaacagctcatcaattcatgttaggtgcagactataaattacataaacaagttgttacctttgttgaaggtcgtttaatcaagaacaaagacagtaataacaaaaaagttactgaccaagcacttggtgttggtttacgtgtattatggtaatctagatagttaggtactatagttaattagctatgatttaagggataagagatgtaatttcttatccctttattattagtcatttttctgctttagcgagtacttttctactgcagttaacattcctcttaataaatttaattcgttggtttccaattcggctcgttgatataaccggcgtagtttcagcataactgcttcgttgcgaataaagccaagttctttatataaacgttcggtatgggcaaagaaatgttctaaggcttctgatgtcgggtattctgcaagcggttgaatatcggttttttcttgcaaatctagccaagccattcggagttcataacaggcgagttgtaccgccattgcaagatttaacgagccatagtcggggttggttggaaagtttaagtgataatggcattttaataattcttcattggttaagcccacccgttctcgtccaaatacaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaagctggcaatctgcgattgcactgtcaatatccgcataaatttgtacattatccaatacatcttttgcccctgcggcaagggctattgcttgttcgtcaatcgcttgttttggggcgacaagccttagccggcttagtcccatcgttttcattgctcgtgcagctgagccgatattaccgctatgagaggtttcgatcaggattatttgaatttgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggattatttgaatttgattaagtaacattttttatatcaatataataggatagtgttatgccattttagcataaaatcaaaccgcttattcttgctttatttagcgtaaatgttacacttaaggctcttttttaacttaggaatgtgaaacaaatgaaaaaattgcaattaaaaaaatggttttcaagcctttttctcctttcaccattagtctttgcagcttctaatgctcaggctgaaggaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggcgtgcaaaacaaggtgtgtgaagatctgacgaagcgtttttcacaaaaatataatgtggaaactcagtttattcacggtggaacagggacaattttaggtaagctgaaagcggaaaaagataatccgcaagcggatatttggtatggcggcactattgagccacatttccaagcagggcagatggggctattagaagcctatcgttcacctttgcaagcggaggttttacctcaatttaaagcattgcaagagagcgaagcaggtaaatatacctcgattgcgtatttgatggtgcttggttttggtattaacaccgaaaaattaaagcagttaggggttgatgctccgaaaaaatgggcagatttgcttgatcctcgcttaaaaggcgaagtgcaattagctgatcctcgcacttcaggaacaatgtacacgacgatgattacgcttattcagttaatgggcgaggaaaaagcctttgagtacttgaaaaaattagatggcaacatttctcaatatgtgaaaagtaccttagtgacctctaacctttctcgtggagagagtgctgtgacagttggctttgctcacggctatgcttcagaaaaagagaaaggtgcaccggttgattatgtgttacctaaagatggggtaggttatgctttaggggctgcaagtattattaaaggtgcgagaaaccttgataatgcgaaattgtttatggattgggttctgtctaaagaggttcaagaaattccttggcgtgaccacggactttatcaaacaccaaccaatgtgaaagcagaagttgccccacaatcacctaaaatagatggggtgaaattggttgatgtggattatgcccgttttggttcaagcgaggaagggaagcgtttggtagacaaatggctctttaatatcaaattatcgaattgatcttctttatagaaggaagggatattttcattagagatgagccctagtattcattctcatagatcggagactagggcataaattatctttttaagatagaagagtattttttcagccctgtccgtaaggtacggggagaacgtcaagataagtagtatgtaaagaattataagtttggattgcaatgggacagtttaggttttgtaacaccagccatttcacttaattcatccatatgattaatggtaatatatttaccttgtaccgttatgatgccatttttctggaatcgaccaagtaagcgactgatagtttcaatggttaaacctaagtaatttccaatatcaccacgggtcattgttaagcgaaattctcttgctgaaaaaccgcgtgcggcataacgttgtgaaagattgtaaataaacgccgcaagtttctcttccgcactcattttagaaagcaacaaaatcatctcttgatcgcttttgatttcatgactcatcaaacgcataatctgatagcggatttttggcattttgccagctaaatcatctaaaatatcaaaaggaatttcgcagatcattgacgtttcaagagcctgagcaaaaccgatatgtttcatatccataatcgcatcaaagccaactaaatcgcccggtaaatggaaagcggtgatttgctcttcaccattttcactgatggtatagcttttaattgtgcctgaacggattgcgtagatagacttgagttcatcacctgactgaaagatgatttgtgatttttgcacaggtttcttacgctcaatgatattatctaattgagttaattcgtgttcattgagagtaaaaggtaaacataattgactaatactgcaattttgacagtgaattgtgcaggctgttcttccatttgctttaaaatcagatacaattttcatacgcaaccatcctaaaatttgatttaaggcaaattttaacatttttttagggaataatgaacaagatttatttagatttggagtgaaaatggcggcagagaaattgactaaaaagagattaattcaaattattgtgatgttatttatcctgatttgcgcatttttatatcgtacttatacgtattcactaaattaggaatgttgctaaataaattattttctacaatctttataaattgcgagtagaatacaccatttactatcaataatattgtttatgtctaaagatactctattttcagcccctattgagaaattaggggatttcacttttgatgaatctgttgcggaagtttttccagatatgattcaacgttctgtgccgggctattctaatatcattacagcgattggtatgcttgcttctcgttttgtgactgatcagtcaaatgtctatgatttaggttgttctcgtggggctgggattttatcgattcggcgtaatgtggaaaaagcaggagtaagaattattggtgtggataattctgaacctatggtagaacgctgtcgtcgccatttggaagcctatcattcggatattcctgtggaaattttatgtgatgatattcgtcacgttgagattaaaaatgcatcaatggttgtcctaaatttcacgttgcaatttttgccaagagaagacaggcttgctcttttacgtaaaatttatcaggggttaaatccaaatggtgtgttggtgttatcggaaaaatttacttttgaagataacacaataaatgaacttcttattgatttgcaccacacgtttaaacgtgcaaatggctatagtgagcttgaagtaagccaaaagcgtacagcccttgagaatgtgatgcggacagatagtattgatacacataaagcacgcctaaaagaagcaggtttttcacaagtagatctgtggtttcagtgctttaactttggttctatgattactattaaataatgaaattagtgtagttgaagtagattattaacaaattttgtgtctcgctatttttgtacgggctaaaccagctgaaaatttttggcaaattcggtaaactacctttttatcatttccctgaaaagagtttcatcaatggctgaatatcaaaaaaataaagatcctcaaaaagataaacagattgaacagataaacattgcccctcactcaattgaagcagagcaagcggtattaggcgggataatgctgagtaatgagtactgggacggcgttgctgagcgtgttcagagtaccgatttttacaatcacgctcatcgtctgatttttgaagaaatggcttcattatctcgtaacaatcagcctattgatattatcacacttgatcaagtgcttaaaaataaaggcatattgcaagatataggcggttttgcctatcttgcggaactatctaaaaataccccaagtgcggcgaatattttagcttatgcagagattgttagtgaacgggctattcgtcgtgaattgattgctgcgggtaataaaattgcagaaatcagctacaatcctaagggattgacggttaaagaagtcttagatgaagcggaaagaacggttttccatatcgcagagatgcgaactgcaactgacgaaggaccgaaaaaaattgatgatattttaatggaaactttagctcgcatagaattactttctcgttctcaaaataacagcggtgtaacaggtatatcaacgggctttgctgccttagatcgaaaaacggcagggcttcagccttcagatttaattattgtagcagcccgtccatcaatggggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaaacaacatttgcgatgaatttgtgtgaaaatgcagcaatgggagatgttgaggtcgaagatgagaatggcaataaagttaagcaaccgaataagcctgtgctgattttcagccttgagatgccagcagatcaaattatgatgcgtatgtttgcttcgctttcaacggtcgatcaaacgcgtattcgtacagggcaactagatgatgaggaaatgtctagggttggcagtacagtgggggtgttgcaatccagaggtaatatttatattgatgatagttcaggtttaaccccaacggaattacgttcacgcgcgagacgtgtgtacaaggaaaacggtggattaagtttaattatggtggactatctacaattaatgcgcgctcctggatttgccgataaccgaacccttgaaattgcagaaatttctcgctcactgaaagccttagctaaagagttacaagtaccggtagtggcactttctcagctcaaccgtagtttagaacaacgttcagataaacgccctgtaaactcggatttacgcgaatcgggatcgattgaacaagatgcggatttaattatgtttatttatcgtgatgaggtttatcacgataatccagatacaaaaggaatggcggagatcatcattggtaaacagcgtaatggtccaatcggacgagtgccattaggcttccaaggacaatattcacgtttcaccaattacgaaggcagctatagactagaggacgaataagatgttatgtgcaatttataaaagccctaaaaaagaaggaatgtatctttatgtggaaaaacgggataaatttgaggcggtaccgctagaacttcgtcaaatttttggtaaacctgagtttgtaatgttgtttaatttagcaggtgagaaacagcttaagcgagtagataatcaagaagttttgcaaaaaatccaaaaagaagggttctatttgcagatgcctccgccccctgaaaacttacacgctgaatttgtagcaagacagaaagggttaaaataatgcgttgtccgttttgtgctactgatgatactaaagttgtagattcacgtttaacctcagatggataccaaattcgtcgcagacgagaatgcccagtctgtaaagaacgttttacaacctttgaaagtgctgaattactcattccgcatattgttaaaaataatggtagccgagaaccttttgatgaacgtaaattaagaaccagtttatctcgtgcattagaaaaacgccccgtcagcacggacgatgttgagcaagcgatccaccgcattgtgttacagcttcaagctacaggggaaagggaagttgctagtaaatttgtcggagacttggtgttaggtgaattaaagtccttagataaagtcgcttatattcgatttgcgtcagtttatttaagttttgatgatgtagaagaatttagtaaagagattgagcgattaaggaactgaatatcaattaagcagagacacccatcaatgtcttattcggctctttcgccatttctcgtgctaatttcggcactaagtaacccgatgtaatgcgttgcaattcacgataaatttcaaaggctctgctatcttcaatataaaaatggctcgcccctgccactttgtctaataggtgcaaataatagggtaaaatgccattgcgaaataatttatcactcaaggctttgagtgtttgggcgttgtcgttgatccctttgagcaagacagattggttgagcaacacaacattgctttgctttagcttctgcattttttccgcaaaaatgtcatctatttcgttggcgtgattgatgtgcgtcactaacacgaccttcaaacgactttgtaatagccgttcacataattcgtctgtaatacggttgggaataaccacaggtaaacggctgtgaatacgcacggtgttgatatgggaaatctgttctagttgggtgaaaatccagtcaatttcgtggtcttttgccatcaagggatcgcctcctgataagatcacttcttccacttcggaatgtgcttttatatagtcgaggcttttctgccacgttgctttgccacttttgacttcatcatagggaaagtggcgacggaaacagtagcgacagttaatcgcacagctattttttaccataaataacaagcggttatgatatttatgcaaaatgttaggggctggcgaatgctgttcttccagtgggtcttggacaaagccatcaacattggtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttcttgtaatgtgatcgcttgtaaaaaaaggggatctgcccgatccccctttttcattttttcggcaaaggggcgtggcactcttaacgcaaacagtttacgagcggtaagatcttgctcaaaatctgcaatgtttagctcaaggtaattcaataaatcttctggtcgattaaaggattcagccagatcttgtagccattgagctttcgttggtgcgtcgtaaaatgagatgttcaaatttgccccttttgctgatgaaattactggctaatcacacactgcattggtgcgttggttttatctaccatcaatgtcggtggtaattggctgttgttggttcctaccatatattgcacaccatttaagcagtaacgcaaataacccagtgttttctcaataaggtaagggtcgttttgcggatcgattgctttaaaggttggcacggctggtgcctgttgtacctgtttggttaattgttccgttggattggttgctggtgtttgagcctgtgcttccgttggggaaagagcttcacttaataagtaacctgccgccgcccctgtcacaaaattgcctaaacggttgccttgagcttgttgagccgcccctgcatttggcattgtttgatttggcgtattattaaagtccgcatcggctttttgttgtgttgtggactgctgaaccgttgctggtgtttttttacttgaagaaaatttcattccacctgcttttttcgcttgaacggttgaaacgctaagggcaagaactaatcccattaacactgcttttttcattttatttcctcattgattgaaaaaacagattatacctgaaacgactttatctgccatacttcagaaaaattttaattttttgcctgccgtttttagtgtattatatacgtctttttatttagccctttgggcgttactttttatctaaattctgaggatcacaatggctagttacagcactaatgatttcaaaccaggtttaaaatttatccaagatggcgaaccttgcgttatcgttgaaaatgaatttgtaaaaccaggtaaaggtcaagcatttacccgtacaaaaatccgtaaattaatctctggtaaagtattagagatcaacttcaaatcaggctcaactgttgaagcggctgatattgtagattacaactacacttactcttataaagatgaagatttctggtactttatgcacccggaaacgttcgaacaaatttctgtagatgcaaaagcattaggcgacaacgataaatggttagttgatcaagcagaatgtatcattacattatggaatggctctgcaatcggcgttactccaccaaactttgttgaattagaagttatcgaaactgatccaggcttaaaaggtgataccgctggtacaggtggtaaacctgcgacattaagcacaggtgcagtagttcgtgttccacttttcgttcaaatcggcgaagttattcgtgtggatacccgttcaggcgaatatgtttctcgcgtgaaataatctcgcaatcccctgacaatttgttaggggatttttttatcttcagctagccaatcttcgtaatttaataatggtacacgtttaaattctttgatatgttgataattaaacgtaggatctggctctcccaattcatctaaccaattccaattatcttcaattggctcaataattgcctcattacttttcttctcaattttcatttcatctcatctccgtactaggtactagaccgctaacaaaccatatattaataggttaaatattgtagggtaggttttaatccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgattatatggtgggtcaagacccaccctacaagctactttaccactaatctaatatctaatttttgatagacatatactacccctaattgagaaagttacaaaaagtttatgtctaacaatgtgcttttttatccataaccccgaactttataatgaaaatttcttctaagtaaggtaaaatctttacactttcattactactcactagaggaacatattatgtcagtcgcaattttagaccaacttgaagaaaaaattaaacaggctgttgaaaccattcaattacttcaattagaagttgaagagttaaaaggtaaaaacgaggaagctaatcgtgcaaatgaaactctgcgtcaagaacacgagcaattaaaaactgaacatcaaaacttccaagatcgtttacgctctctgttaggtcaaatcgacaacgtttaatctttgtttgaataaacggctaatacttttgattagccgttttttattacttcatttattatggctaaactctatttttattactctgcgatgaatgcagggaaatccacaactttgcttcaatcatcttataactatcaagaacgaggaatgaatacccttgtttatactgcggcgatagatgatcgttatggcgtagggaaagtctcctctcgaattggtatttcacaagatgctcgtttattcaaaaacgatagcaatttatttgatgaaatcaccgcttatattgccgatgaaaaattgcactgtattctgattgatgaagcacaatttcttaccaagcaacaggtttatcaactgactgaagtggtcgataaattaaaaatccctgtgctttgttacggcttacgcaccgatttccagtctgaattatttgagggaagtcgctatctactcgcttgggctgatcagctcgaagaactcaaaaccatctgttattgtgggcgtaaagcaggctttgttattcgtatgaatgagaaaggtgaagcggtaaaagatggagatcaaattcaaatcggtggaaacgacagctatctttctgtatgccgtttgcattataaggaaaaattggggatataacttagtttctatctatttatctgaataggaatgaattgccaattatatttcaaaggtgaaaagcatgtaggatacagtgattgctttgttttaggggaagcacttgtaataattaataacggaagaatgtaaaatgagcgaagctgtaatttttgatatggacggtacgttaattgattcccaacctatttggtatcaagcaagtactgaattttttcagaaaaatcaatttcctgtaaccttagctgaaatgatgactcttacagggtcaccagttggtacgcttgttgattatgtgctacaaaaatatggcgaaaaagaaaagagccgtactcagttaatagaagagttgatggcatatgtagttggaaaggtgcttgaagcgaagccgttaatgccaaatgtgaaagatgttttatctaccttaaaacaatgggggattaaaatcgcagttgcttcggcttcaccaagaaatatgctacaaggcattgttgatagctgtggtatagctgaatattttgattatttagcttctgctgaggaattggagtacaacaagccacaccccgctgtatatttacacgcagcaaaacaacttggcgttccaacatctgcttgttttgccgtagaagattcggttttaggtatgatttcaggtaaagcagcgagtatgaaaaccgttgttattcctgcaaaatcggaatggggcgaccctcgttgggcattggctgattataaattagtgagtatgtcagaattaccgatgttaatagaatcgtaatggtttgatgtaaatcgtaaagtcccctattgtatggggagcgttttggggaaaaatatggatagacataatttctcaaaactttttctttaatccccccactttcgctataatagcccaaattatttagatcaaagagaattcaaatggcaacaattgcaaaaaatctgctcgttttagtggacggttcgtcctatttatatcgtgcattccacgcatttccccctttaactaacaaacaaggtgagccaacaggggcgatgtatggggtgctgaatatgttaaaaagcctgattgcacaggttgagccaagccatattgccgtcgtgtttgatgcgaaagggaaaaccttccgtgatgagctgtttgaacagtataagtctcaccgtccgccgatgcccgatgaacttcgttcgcagatccaaccgttacacgcaataattaaggcattgggtattccgctgttgtcgattgaaggggtggaagctgatgatgtaattggaacgcttgcagtgcaggcttcacaagcaggtaagcacgttttaatcagtacgggcgataaggatatggctcaactggtaaacgatcatattatgctgattaacacgatgaacaataccttgttagatcgtgaaggggtgattgaaaaatatggcattccgcctgagttgattatcgactatttagccttattgggcgactcgtccgataatattccaggggtaaaaggtgttggtgagaaaacggcgattgcgttgttgcaaggtattggctcaatgcaagcgatttatgcaaatttagacaaagttgcagagttatcatttcgtggggcaaaaacctttgcaccgaaattggaagcagaaaaagaaacagccgatctctcttatctgttagcgacaatcaaaaccgatgttgcccttgatgtcacttacgatcagcttgttactcaaccccaacagcgagatcaactggtagaactctttggtcgttatgaatttaagcgttggctgaacgaagtgatgaatgactcaaaccctgtgacacaaacgtcagcagagaaaattccaaacaattatcaagccacacaagcggtcagttcagaacaaaaatctgcaccttttgtaaaaatttcgatagatcgcaccgcttacgattgcgtgaacagccctgagctgtttaccaaatggctggcaaaattgcaaatggcagagcttgtggcggtggataccgaaacggataatttagatgcaatgcaagcaaatttagtcgggatttcatttggcttggaaaatggcgaagcgtgctacattccgttggcgcataaaggcaaaattacacagtcgacccaagtggatctgtttggtgaaagtgaagcagaactcgatgaagtcgaagcgttactgcctaaccagttgaacaaggcggactgtttggtacagttaaaaccgattttagagaaccaaaatatccgcaaaatcgggcagaatatcaaatacgatttaacaatttttgctcgcaacggcattgagctacaaggggttgcctttgatacgatgttgcaatcttacaccctagacagcacaggtcgtcacaatatggacaatttggcagagcgttatttgggacatcaaactattccttttgaagagttggcaggtaagggcaaacatcagcttacattcgatcaaattgaactggataaagcaacagaatatgcaggggaagatgccgaaattacaatgaaattacatcaactcttatggtctgaactacaaaaaacgcctgaattggtgaaactgtttgagcaaatcgaaatgccgttggtgagcgtactttaccgtgtggaacgaaacggcgtattaatcgatcctgccaaactgttggcacattcagttgagattgaacagcgtttaaaagagcttgaaacccttgtacatcaagaagcaggagaagtgtttaaccttgcttccactaagcaactgcaagagattttatttaacaaactcggcttaccgattttaaagaaaaccccgaaaggtgcgccatcaaccaacgaagaagtgttggaagaactggctcaaatgggacaccaagtgcctgtgctgttgatggaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgtggcttgagcaagctgaaatcgacctataccgataaactaccgcagatgattaatgcacaaacaggacgtgtgcatacttcatatcatcaagcggtcacggcaacagggcgactttcatcaagcgatccgaatttacaaaatattccgatccgcaacgagcagggcagacgtatccgtcaagcctttattgcccgtgatggctatgtgattttggcggcggactattcgcaaattgagttacgcataatggcacatcttgctaatgatgcgaatatgatcaaagcctttgccgaaggtaaagacattcaccgttctacggcggcggaaatttttggcgtgccgttggaagcggtgaccagtgaacaacgccgtagtgccaaggcgattaacttcggcttgatttacggaatgtctgaatttggcttggcaaatcaactgggcatttctcgtaccgatgcgaaaaaatatatggaactttacttccagcgttatccagccgtgcaacagtttatgttagacattcgtgaaaaagccgctgaaaaaggctatgttgaaaccctatttggtcgccgtttatatttgcctgaaattaactcaagcaaccaaatgcgacgcaaagcggcagaacgtgttgccatcaacgccccaatgcaaggcacggcggcagatattatcaaagtggcaatgatcgggatcgatcaagcggtgcgaaactgcgaagatattgcaatgattatgcaagtacacgatgaattagtctttgaagttaaagccgacagagtagagcattacacccaactgattaaagccgaaatggaaaaagcaattgagcttaaagtaccattgattgcggaagttggagttggaagcaattgggatgaggcgcattgataataaaggggactaaattagcgtccccttataactatttttaatgaatccaatgagctaaatttatttagtcatcactactaaatactcctaaaagctgtaataagctcacaaataggttgtagatagacacatataaatcaacggttgcacggatatagtttgtttcaccgccgtggataatgttgctagttgaatataaaattgcagccgttgagaacactacaaataatgcactgatcgctaaacttaacgcgggcattgctaagaagatatttgccacaatacccactaataacaccacgaacaatgcaatcatcattcccgataagaaagacatatcacgtttggtagttaatacataagcagaacagccaaagaacactaacgccgttgcccctaacgctaatgcaaccacatcgcctaacccattgctgatataagcatttaaaattggacctaagctataacctaagaaacccgttaacgcaaaaacacttgctaaccctgctgcactatttgccgttgcattagttaagaaaagtaagccatagaaaccgactaacattccccaccaaggtaaacgtggtaaattaagtgccatagtaacagatgcaactaccgccgaaaatacaagcgttaacgcaagtaagaaataagtattacgtaatactttatgtgtgctaagaagggattcacttcttgcggaagtgactaaacgatcttgcatagaatctcctgtaaataaatagtttttgtgttaaaaacgcccacaaattagcgagaaatcatagaaaagtcaatgtatttcacaaaacaaagggcgtatctctacgctcttactcttttactgaactgccacaacccttccttcttgataatccactgtcacaggactattcggcaacaatttgccagagagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgccgatatgatcaactgccgcatcggtcaccgtcacttcatagccacgttccgccatacgtttaattagacgttcaagctgtattcttgcaatcgcacggatattttctttatctaatgggtggaataccacagtttcatcaatacggttgataaattcagggcggaaatgttgcccaaccacattcatcacgatagttttcatttcatcgtaactcatattttccgcattctcttgaattaagtgcgaacctaagtttgatgtcataatgacgaccgtattacggaaatccaccgtacgaccttgtccgtcagttaaacgaccatcatcaagcacctgcaataaaatgttgaatacatctgggtgtgctttttctacttcatcgagcaatacaaccgaatatggacgacggcgaactgcttcggttaagtatccgccttcttcatagccgacatatcctggaggtgcgccaactaagcgagatacgctgtgtttttccataaattcggacatatcgatccgcaccatcgcatcttgatcgtcaaataggaagttggctaatgttttgcaaagctctgttttccctacgcctgtcggccctaagaataggaatgaaccgatagggcgatttggatcagacaagcctgcacgactacgacggatcgcatttgccactgcatcaacggcttcactttgaccgatgacccgtttatgtagcacctcttccattcgtaatagtttctctttttccccttccatcattttggatacagggatacccgtggctttagaaagcacttcggcaatttcttcatcggtcactttggtgcgaagtagatgattttcaccgccttcttcttcacgttttaccgcttcttgtaactgtttttcaagggctgggatttttccatattgcaactctgacattttttcaaagttattctcacggcgagcctgatccatttcaattcgggcattttccaactcggttttaatgtgttgcgtgcctaacagagcggatttttctgctttccacacttcttccagctccgcatattcacgttcacgagcggtcagatcctcgtctaattttgcaagacgctgacggctagcttcgtcttcttctttttgcaatgcttgacgctctaatttcaactgaataatacggcgttcaagtttgtctaacggctccggtttagagtcgatttccatacgcaagctcgacgctgcttcatcaattaagtcaatcgctttatcgggtaactgacgatcggaaatatagcggtgcgaaagggttgcagctgcgacaattgcaggatccgtaatttgaacgtggtggtgaatttcgtaacgttctttcaaaccacgcaaaatcgcaatggtatcttcaaccgtcggctcatcaaccaacactttttggaaacgacgctccagtgctgcatctttttcaatatattgacgatattcatctaaagttgtcgccccgacacaatgcaactcgccacgagcaagggacggtttcaacaagttacctgcgtccatcgctccatcggttttacctgcaccgaccatcgtatgaatttcatcaataaacaggatcacttgcccctcttctttagcaagctcattcaataccgctttcaaacgctcttcaaactcaccgcggtattttgctcctgcaatcaaagcccccatatctaaggaaagtacacgtttgttttttagaccttcaggcacttcgccattgacgatacgctgtgctaaaccttcgacaatcgccgttttccccacacctggttcaccgataagcactggattatttttagtacggcgttgcaatacttgcactgtacggcggatctcttcatcacgtccaatcacaggatcaagtttgcctgccttagctcgctcggttaaatcaatggtatatttttgtaatgcttgtctcttttcttctgcattttgattattcacactctcccctccacgaatttgttgaatagcggctgtcactttctctttggttaaacctaagtttttcaataacttgcctaaatcaccattatcttcaagtgccgcaagcacaaatagctctgatgaaataaagctatcgccaaactgttgcgacaatttatcgcattgatttaacaagcgaaaaagttgttgcgacggctgggtattgcccccttgcacctgcggcaagcggctgataatgccatcaagttcactgcttaaacggttcggttgaacatttaaactggtaacaagcggtgtgattgagccatcattttgctttaacaacgcaagcattaaatgtgctggttcaatataaggattatctttgccaacggctaaagattgtgcatcggcaattgcagattggaatttgctggtaaatttatcaatattcatagtttcccctaaattctgtttattaatgttctgacttcgagattactctcgcttgacgtaaccataaattgggattgtcaaggggatttcaagagaaaatgtgaaagagatcacaaaattatgaaatctattgggggaagagcagctttcaagaagctaatgcatggtcaatttttatcagtattcaaacgatgaaattataggtctttaaatacgtttaaaatttacacttaggaattcccgcctcttgaggcggggaggatgtcagaataaaacctatccgcttgtagtttaaattaagggttagtgacttaacattttgagtaattcttttggctcaacataaccagcgattaactctccttcttttgtgaccatatttggcgtacctgtaaccccaaatttaatcccaagctcataatgctttttcaccatatttggcgtttttacctgttttggtaagttacctttctctgcttcgtttaacgcaaagactggatctttttctgtccaaattgcttccatctgttttgccgtttcagtattcataccgccacgagggaaagctaaataacgaatagtaatgcctaaatcattatattctttgatctttgagtgcaataaatgacaataatggcaagtaatatccataaacacagtgacaacgtgtttttcatttttcgcaggatacacaatcatctcttttgctagactattaagttctgcgagtaatgcacgattagtaatatcagtaactttgccgtcttttaattcaaaaatctgcccgtgtattacatagcgtccatcattgctaatttgcacaacaccttgatcggaaatcgctgttttaaaacctggcaaggcagattctgacaatttcacattagttgccccaattttctcaagttgttgctgtaagtttttatcattcgcctgtgccgaacctaagattgcaaggctaattagggtcaatagaatttttttcattataaatccttctagagtttaagttttgtttcaatattccgtgctttcactaagaatgctttacgttctttatctggcataccagatcctataccaggcaattttactgtcattggattaaccggtcgcccattgatatgaaattcataatgcaaatgtgcacctgttgaacgtcctgtatttccagacaacgcaatacgctgtccttttttcacactttgcccaactttaactaacgatcggcttaagtgcatatataccgtagtatattgtcccccatggcggactttaatataacgaccagcaccgtttgcttggtaagcgatatgttcaacaacaccatctgcaggggcaataatcggcgtaccgcttcgtacagcaaaatcaacacctttgtgaggagcaactcgtcttgttactggatgtaagcgacgaggattaaaatgtgatgaaactcttggtgtaaatggcaatgggtaacgagcaaatcctttacctaacgtttcaccgtgacggttataataacgtccattatctgcttgaatagcataataacttttcttgccactgatgatatgaatagcttcaacattacctaaatcagtaaccttaccattgatatactcacgcttcactaaaattgcaaatttatcgccttttttcaatttattggtggcaatctgccattgcagaccgttagctaactgattaatttgacgttgagataaacctaccgcctttaagctggcactaaaactaccatcaatggtgcctttaatcacatcttgttgccaaacaccttttttctgaatagtttgtactgcaaattgatcttgtgctttacgctcaaaaattttctcttctttttctgagataagccagttcatatattccagctcaccgttattgtctaaaatccagtagaactgttgtccaactttaagctcggctaactgtggaaaagttttttctaaggcttttgctgtagcatgtgttaatcctgactgctctagtacatctttcagctgatcgccttgagttacgatataactaaactgattttggatacgtaatgcttgatctgcaatatctagcagatcttctaacacactttctgcttcttctgataatttttcactttcaggtacaaccgcagactgaccttctacttcatcatcaacatcacttaactcatcttcataagaggttgcattttcatcaacaggctcggcattcacttgttcctgttcctctttagcagaggcagtaaaatcaatgctgatatacttaggctcaccatgagataatcctgttgaaacttcaggcaacgactgagtagccaacgtaatcgggatttcttgagcctctgaagaatttgaactcggtctttttaaggttaaagcgataccaataaagatagataatataatcaccaaaaacacaaatgccttagttctattcttcttacgacgccgatctctagcaaaaataacgtgttgcaaaattctatcctaaataatttcttctatgctaacttattatagacaaaggaatgggcaaaaaattcccgtagctttcttgtaaaacagcaaaaaatccgctaattttaaatccttaaatccttaaatccttaaatttattaatgttatgcagatcaagcaaattaagccgatccacaatttaacgaagccccttgtgcaactgaaagcgattaatgtgaattttggtacacaagttgctcttgaaaatattcatttaaacatctaccccaattctatcacaactatcgttggtcctaatggggggggtaaatctaccctattaaaagtattgctgaaattacagccagcaacatcaggggaggttattcaccaaccacagctaaaaattggctatgtgccacaaaaattgcatctggatcactctattcctattaccgttgaaaaatttctatctctcaagcctaacagcactaaacccttgatagatgaagcattgtccctattttcaatcactcaccttgctaagcatagtatgcaaaaattatctggcggtgagttacaacgagtactgcttgcccgtgcaattttagaccgtccacaactgcttgtcttagatgaaccaatgcaaggggtggatattacagggcaaacggaactctatcaactattaaataaaactcgtgaatggttaaactgtgctattttaatggtttctcacgatttaaacattgtaatggcaaatacggacgaagtgctatgcgttaatcgccatatctgctgtgctggtacacctgaaaaaatttcaagtgacccaagttttatccacttctttggtgatcaatttgcgaaaaacgtggcattttattctcatcaccataatcaccatcacgacttacaaggcaatgtatgtcgttgtaacggacatcactaattgaggcaatatgtttgagattttatttcctgcgtggttagcaggcgtatttttaaccttcatcaccgcaccgcttggagcttttgtcgtctggcgaaaaatggcatattttggtgataccctctctcactccgcattacttggggttgcattaggaattttcctacaaatcgatccctatattgctgttattctaatgaccgtcatactcgccctttgcctcgtctggttagaacagcactctactcactcagtcgataccctattaggcattatcgctcattgcagtttatccttaggcgttatcaccatcagcctattagacaatgttcgtgttgatttaatgtcctacctatttggtgatcttcttgcaattggttttaacgacgtactctttatcagcatcggggttatcggcattgcgacactactggctctgtattggaaaaagctactcgccatcacagtcagccctgaattagctcaaattgaaggcctaaatgtcgcacgcctacgcctcttattaatgttgctcaccgcattaaccattgcattaagtatgaaatttgtcggggctttaatcatcacctcactactgattatcccctctgcaaccgcaagacgctttgccaaaacccctgaaacaatggttatttacgccatcggattaagcatattatcggtcagtggcggattattactctctgccctcaaagatacaccagcaggaccttcagtggttgtttgtgcaggaacactctttttactctcattaattaaaaaagaggcgaattaagatcaataaaatataattttcctattgaattttttgtcaaatttcgcttaaatcccaccgcttgttaatgataacaagcggtgggatttttatatttttttgaagtaaataaagaagtaaattatgtgtcaattattaggaatgaattgtaatacgccgaccgatattactttctcatttgaaggatttcgacggcgtgcaggcttaaccgaccaccataccgacggcttcggcattgccttttttgaaggcaaaggtgtgcgtatttttagagacaatcgcccaggtgcctcatcaccaatggcagatctcgtcagtcaatatcgaattaaatcctttaacgttatcgcccatatccgtaaagcaacctgtggcgatgtcaatttagaaaatacccacccatttatccgcgaaatttggggtgaaaactgggtattcgcccacaacggcacggttgatgtcaaagtttgcccgaataatcactatcagcctataggctcaacggactctgaagccgcattttgctgtatagttgccagcttaaaacaacgttttccacagaaaccaagtgaaaaagagatttttgacgcaattgtagatattgccagtgaaatcgctaaacacggcgtatttaattttattctttccaatgggcactggatgatcgtacgttgctcaacaaacttacattatgtctgtcgcaaagccccattcggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcattgcgtgatgatgatgtaatgattgatttccgtgaatatacggaagaaagtgataaagtcaccattattacaacccaacctctcacaaaaaatgagaactggacaaaaatgaaaaatgggggctatgtcttctttaaagatggtgatgtactctttgaaattgaaggtacactacctgaatgtaaacctcacgtttaaaatagattgcccctttctatactcaaaaggggcaatctacttttttacttaatcggcgttgccgtgcgttctaacacttcgagcaactcactgatattctgtttaccctgtgttttaagccactggcgagcggcttcaacaccttcggctttgtaggcttccgcgccaccagcccaagtcgcacgtccgcacagtacgccgttaaaccggctgcctgcttggtgagcaaattcaagggtttgttggaacagtttggctgaaacacctgcacttaggaaaataaacggcagatctgttgcttcgctttgtgctttgaagaatgcagcggcttccgcttgactgtaaagcacctcaccgtcagtaaagccttccacatagctcatcaccacaggcacttccactttcaacacatctaccccaaaacgtttgtccgcaaagaacttcatcgcttcgattactttgcaaggtttgactttggcgttatagactttatcttcgtttgagccatcgtaggtcaaaatctctaagaacaacggaatttgttccgcattacattccgaagcaacacgttcaacaaaggcagctttgcggtcgttaatttcgtgtggttcatcaatgtcaaaatagatcaacaatttaaccgcttccgcccctttttcttttaagcgatagacggacacatcatcaatcaaatcagggaaacgacccacagcggttttatcatagccagttttttcgtacgccataattaatccgcaatttgcatcacgtttctctgaagccgcccagccaaattccggatcaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccggatcaagtaagatcgacgacgcatagggggttaattcttgagagatcaaagttttaaattcgctgacctgctgagcggtaatatcatcgcccatcattcggcgtaacgcaccacgttggtcaatcgcaagagcagcaataatgccctctttggtgcaaagttttttcattaaatcttgtttagacatactactactcctattcatcatcgcctaacgctaagtttttaagttgttgagccacatcgtgaatttgttctttggcattttccagtaagccgtccgtgccttcttcactcacatagctaatcaccatcggtaaattcattccgctatataaccctgataatttcggcaagtaacgcattgccacattacacggcgtaccgcccataatgtcgcaaaaaaccacaatctcaccgcttgcattcgccagtgcttgctcaaatttcacttggaaatcttcattgccttcgtgtgggtataagcagacggtttgagcattgtcgattttgcctaaaatcatttcggcagtatccagtaagccttccgcaaactctccgtgactgattaaaattaagctcatagttgctccttttggtagttttgaattttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatctttaaatccccctcaatccccctttttcaaagggggaagtttgacgatattttttgggttgtccttataagttcttagtattcaactctttataaatcggcttatcactaaatgttaagctatcgatcttcaccccttccgtttcaaagacgataatctcattctcgcctttgtgcagtaacggtgcaggcagataaagataacacgttgggccttcattccagtaacgccctaaattctcaccatttaccacaattacccccttgccgaactcacgggtatcaataaaggtatcttgcggttcttggtctaggtgtaacttaaattgatagaacgaaggcgtttggctgtctttttcgccatcaaaatcaatctcttccaagcggtcaaaatcaatcgcatactgttgccagcctgtgtggaaatgcagatcaagcacagcccctgcaccgatacctttatgttgtgtcgctgcaagtagcttaccgccgtaattcactcgtcccatattttccactaacagatcaagttggaactcgccatttggtgtctgtaacatcacttcattgccgatctcgtgttgatactgggtggcaactttttgtttatcgttgaaaatctgaatgcgatctctgccttggtaaattctcagcttgatctcaccgctatatgctgtcggtttggctcgataaagcagataaccgtagtaatgccctagctgttccattgtttgagtgaacgagctttcatagcattcgctgattgtgtctaaggtaccaaacagcgagacttcattttgcactgcaagcggtgggtaagcggtgatatttggcaaaatcggatcgacaatcgggctggcatcgggatactgccctagcactttttgtagcaggtagaatttctctgacggttcgccccattcgtgaacaggggcatcatagtcgtagctggttacttgcggtaaatcggtgtctaaccgtgcggaacagccgttccaaaagccaaaattcgttccgccttggaacatatagaaattgatacttgcccgttcgagtagctctttggtgcagtccgctaaatcttgagcatcacggcggatcacaggctctttccaacggttaaaccaaccgtcccaaaattccatacacatcaacgggtaagatttgccgtgcttatcaatataacgttgcaactcatctaaattttcattggaacgagagccgaagttccccgtcggcaaaatatcatcttcgatcaacgcccctgcttctaaggcgttctgccacgcaccgtctgacgtgaaaagcggtacgttcaccccgtgaattaacatcaacgcccgaatagctcttaggtagtttttatcattgccgaacgagccgtattcgttctcgatttgcatcattaagatattaccgccttgggtaatttggtaaggggcaatgcgtggaagcagttcttgaaaatagcggtcgatttcagcgataaacagcgggtcgttttgacgtaagcggatatttggaatattaagcaaccacgcaggcaatccgccaaactcccattccgcacagatataaggtgttgggcgaagaataacgtacagccctaaatcttttgccgtttgcaaaaatttgactaaatccgcccgcttgctgaagttaaattgatcaggctgtggctgatgtaagttccacggcacataggtttcaaccgtgttacaccccattgcctttaggttgtagagcgttttgtaccagtattctggcacgatacgaaagtaatgtactgcacctgacagaattttgaacggttttccattgagtaggaaatccttttcgccgatttggaaaggcatagttcacctcgcttaaaagatataaaaccgaataaatctagagaagagcgattgggttttagatcttggttatttgtaacattttgaatgaatttgaccgcttgttttaggacgccaagcgtggcgtcgctacaataacgttgtattgatacgcgggtagggacacactgcgtgtgtccgttccaatatttcccacaaccacattattaatcaagttgaatgattattgacggacacgcgcagcgtgttcctacaagactaaatccgaagtggttgtagggacacgacgcttcgtgtcccttttaaattaccctttcgccaacaatccagcccaagagagcaagatacagagtgcgatgatgatcataatcgctttgttagagttcattttcggtctgccgagtaaccagtagatgaagaacaccactaacgcagggactaatcttggtaagataaggtctaggtttgcttgggcggaaacgactttctcaccgatagtggcaacaaacggtactttgacattcaccatcgtggcacacattacccccacaacgaataccccaagcactgttgcggcgttggttagtgcgttcaagcggtgacttaggttggtcactaagtttaccccttcacgataagcgattttgagttgcacccaacggaataccattgttgcaatcgctaccgcaacccataagccgacaccaagcggattgccgtttactgccattgttgcggcaatcgcccccataattgctgggacgagtgagccgaatagggcatcaccgatagcggcaaatggtcccattaaacctgatttgatacctgcaacggcttcaagtgatttcaccccttgtttttcttcaagagccaagtcgatacctttaacaatggtgttaaagaatgggctggtgttgaagaattggttgtgcatcaccatcattttttgtagttcaggtgtgttgtcgccgtacattttgcgtagctgtggcaacataatccataaataacctgaaccttgcatacgttcgtagttccaaccaacttggttgaagaataagttacggatattgatttggcggaagtccgcatctgttaatttgtagccttttggatttccgacttgttgattagagttcgtcatcttcaatttctcctttgtcagaagtggtattttgttttgcaactggggctgagccaccttctacgctacgttggtaaacaatgtaggcgaatgcaaatccgattgctgccattgcaagcattggtacgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgattgagttgcttacacctgttgatgcacctacagcattgatgttaccgaagagagtaatgaagattgctgtgagtgagaatgcaaggattaagtatgcaatgtgacgttttgttggtaagtaacgaagtaagattgcgaaacctaacgctggtaatacgccacctgcaagggttaagccatctgcgataacttttaagaagcctgtttgcattgcttctgctaggcttgccacaaatggaccaccaaacactaacgctaagaagattggtaatgcacgagatataccccaagcgattgcaccgcagagatagtttactgtgattgcactataagcgtggtcttggatatttttgtcgatacggtgagcgaagaatacgttagacattctcgctaaaatatcggtataaaccattaacgctgcgattggtacagctaaggttgttaaggctaattgtggatccattccagctgcaacagagaatgcagttgcgataacagtacctgagtttgcatcaatacgagatgcaccaccgaaggtacctacacctaaaatggttaattgcattgaaccaccgattaacaatccagttgtcaaatcgcccataattaaacctgtgataaagcctgcaaacacaggtgaaccagcactagatacaatcgtgatttcatctaggatttgatagaacgcataaagcgttatcaaaagtatttgccaccattcgatcataatcgttactcctctataaaagtttcattaaatcgactttttcttcattaggcactaactgagcagtaagcttcacgcctttttcagaaagttttctaaacacttccacatcatcttcagtcacgtgtactgtttttctgataggacgcgttagatccgttttaggcatattccctgcattgacttccggcagatttacgcctgcctccacaagctgtaagatcgtttgtggggttcttgttaccaacaaaacacgttgagagtcataacgcccttcgttaatgttggcggctgctttttccacaggtaacacgcttaaatttacccctgccgggcaagccaagcgtaagcctgctttatcaatgtcattatttgccgcgacttcatcgacgaccataatgcgagtgatattgagataagacgtccataagtttgccacttgaccgtggattaaacgtccatcaatgcgtacatttaaaattgccatttttgcctcctgtatatcaatatggataaatcgttacaccttgcaccacacgattaacttcgcctgtcggacaagggttatccgtggtgtagccaagatagagtgagctataaaacgagtaaagttgcccgattactaagaatgggaaaatccgtgctgcgtcatctaatttgtgaatttcagctcggatcgaaccgcttgtatcgcctagtaacaccacttctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgcggtataaggttgctgagataagaagataaaaatgagcgtttcatcttgaacaagggattttggtccgtggcggaagcccattgacgactcaaagaagccaagacgttcaccagcggtgagttcaagtagttttaaagaagtttcacgggcaagcccttggaaatgcccactgcctaaatagacaatccgttttaatggtagatgggctaaacgttggatttcgagcagatcccgttctagtaactgttctgtcaccgataccgtttcctcaacccagctatcatcaaatacatcgggtaaaaatgccactaatgccgctaacatcatattgctggcactggaggtcattgcaaagcctctatcgtgggttgattctggtaatgctaatgggtaagcggtcggatcttgctgacattttttaaataatgccccattgacattattcgttatggctaaatgatacgcttcctctacaatttcatcgacaagctctactgccccaatactttcagggctattaccagagcgagcaaaagagactaaaagcgttggtttatccgcaaaaagatattgataaggattggatacaagatcagtacttgcaatcgcttcgatagcacaacctaaatgctggcttaatatcggtgcaacaacctcaccaataaaagcagaagtacctgcccccgtaaaaataacacgaagttcgccttgttttgcatattcaacaagaggctgaagaaatggaataacaagtgacgatttcacaatagaaaccgtttcacgccaagtcgctggctgttgggcaatttcctttgccgtccaaaaagcgttctgcttttctaatgtttggttagctatattgaggatcattgcatttccctcacaaataaatggatttatttataaggaaagagaataaaactacgcaattaacacttgcaccccgacattttcgagatactctcgataacttagaggaattttattatccgtgactaacacatctatttgattggcttggcaaataacaaaatggctatattgaccaaatttgctcgaatccgtcaccacaatcacctgatccgctgcatcgcacattaatcgatttagctgagcctcttgctcgttaaaggttgtgacccctttttgtaagtcaaaaccatcaacacccaaaaagactttatcaaagcgataatgttgcaaattattatccgccattactcccgaaaacgacatcgcatttttccgtaaaacaccacccgtcattcttacttccacattcggacaagaaaccaacgccattgcgacatcaagcccatttgtcaatactgtcaagttaagatcaccgatagcacttacgattgctttcgttgtcgttccagagtccaaaatcaccttctcaccctcttttaacaaagaagcggcaagatgaccaatctgttgtttgagttcgggataattattacttttatccgcaatagaaagttccgctattaatctggagtttaacactgcaaaaccgtgcgatcttgtaatatagccttgttgctctaacacattaagatccgaacggatagtaaccgtcgaaaccccgaaatgctgagacaatgcttcaactcgatgactgcctgttttttgcaataacgccaaaatatcagaacgtctttctacgctacttttcattttctctcctacatcaaaacaaccactgcatactacgattgctttcgaaagtaagtttataccccttaaaaacaaaaacaatcgaaaatattcgaaaatgagataaagatcacaaaatttacatttggtgttttaagcaagaaaatgttttgtcacgtttatagtaatttgggcttggaaagtttcctactatacttctataccacgaataagtgattgttgtattcgtgctcaaaatggttactatcattttgagttatggtgatataatcaaagtaatgaatgatgaactttcagtaacttattgattgataatgaattttagataaagagagatgttatgacatattggttcaaaaatgtaatgatttaccgtttaactagtgaattacgcttcaccagtagtgaattagacgcacaattacagcaaacaaaattcaccccttgccaacaaagcgatatgcaaaaatttggctggtcgtcaccgcttgcaggaagtgaactgttgcactttgcacagggtcagcagttcctactggtttcccataaagaagaaaaattattgccagctcacgttgtcaaaaaagaaacggaaaatcgtattgaagccttagaacaaaaagaacaacgcaagctgaagaaaacggaaaagcaggcgatcaaagatgatgtggtggcaatgttgttgccccgtgcgtttagtaaacatcaatttacggcgatttggctagacttagataaacagctcgtttatgtagatagtggctcggcaaaacgtgccgaagatacccttgctttattacgcaaatcccttggctctctgcctgttgtgccgatttccttcacgctacaaccgagcgaagtgatgacaaattgggtggcaaaagggcatacaccaagctggctgacacttctggaagaagcggaattaaaatcttttgataccgacagcgtaatccgttgtaaacgccaagatttagaaagcgacgaaatcagccaacatttacaagcgggtaaatttgtcacaaaacttgcgttagattgggaaaatcatttttcttttgtgttgaacgaagatgccactcttgcccgtgtcaaatttgccgatgaagtgcgtgaaaagaacgatgatattttgaaagaagacaaagcccaacgtttcgatgcggattttctgttaatgacggaagaattacgtctgtttacagaaaaattgacggaagagtttgggggggtaaattccttgttatctttttagctggtctactatttctcagccaatatttttttatttggaaacttgattgtttttttcgagctagaatggttctattttagaacgattcgctttttttgctgggcgttcttaaagtatgacactcaaacccgatctttttttgaagatcgggttgattattctttagttggcgctgaattataatttaactattctatcattttgtttaatagtagaatgatgaaagattgtggaatagatgttatagagggttatgcaaacatttttttttcgtcattcattgacttgggttatttttgcttttttaggcttttgctttttcccagtaaaagcattgcaatatggactgtttggagcaacttcagccgaatttcaacaggctatggggtggaatgatattaaccttacttggatatggttttttcccctactgctttatctgtatccgaacaaaacaccttcaacattacgaagtaaatgtgagttattcggggcagttgggctgtttctctttatctttctttccgcaattttagcaaaaatcagcttaggttatgcggtttttttcttaattgttgcgttgattgcgttagcgacaaatgcccttgctgaattaaaaataatgcagggtgacagatttattattgcctcattgattagcattattttgttgatctttttctttatggtctatccaacactggcaattttcatctcaatgttttacgacggcagtgaatttgtaccaagtcaagtgttgtctatcttacaacagccttatgtattaagagtgattggtaattcattaagtgttgcgacaactgttgggattttatctacgttgtttggtttagcctttgctctttataccacacggattgcaaaacgcacggcgtttattggtaaaattttctctatcttacccattgtaacaccgccatttgttgttggcttaggtgtcacccttatgttaggacgttcgggctatgtgactgcttttttagtcgattatcttggctttagtaataactggctttatggttttacagggatagtgattgcccataccctcgcactgaccccaatgtcttttatgattttagacggtgcattaaaatctattcacccatctgtcgaagaagccgcttatactttacgatctaaccgctatcaagccttcttctatattatttttccattactcaagccagcgttagccaactcgtttttagttgtggtgatccaatcgcttgcagactttagcacccctttagttttaggtggaagttttgacgttattgccactcaaatctatttctatattgctggttcacagttagattatgcttcggcaagcaccttaggtgtgatcttgttactcttttcccttacgatttttgtggtgcaatatctctggattggcaatcgatcttatatcaccgtatcaggtaaatcttatcgaggtgatgtacaagcattaccaagcggtatgaaatgggcaattatttgcactttaggtttttgggttctgtttaactttgtactatacggtagtattttttacggtagctttaccgtaagttggggaatagaccacacactgacattcaataactacctcaatctttttggacaagggtttaatagtggagcgtggccatctttaatccaaacggttatttttgctgctagtgcagcaccgattacggctatttttggtttgttgattgcttatattactgttcgccgtgattttaaagggaaaaagcccttagaatttctgacgttactttgttttgccgtaccaggaacagtgactggggtatcctatattctggcttttaaccatcaacctatttacctgacaggaacagggcttattattattttgtctatggtgatgcggaatatgccagtaggaatgagggcggctattgctggattaagacagttagataaagccttagatgaagcctcgctctcactgaaagctggaacattaaaaacaatctgctttgtcgctttaccgcttttaaaaccggcgttactttctgccttagttacgagttttattagatcaatgacaacagtcagtgcgatcatctttttagttacagcagacacacgcgtcgcaacctcatatattttaaatcgagtagaggatggggaatatggaatggcgattgcctatggctcaatgttgattgtagtcatgatggcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttatttgattggcttgttggcgacatgcatatagcccgttcaaagcaaaaagatgaatttggagagaaaaatggaacaaaaaaatgattttctcgtgttgaaaaatatcagcaaatcttttggtaaacatagggttatagataacttaaacttttcaattaaacaaggcacaatggtcacgttactcggcccttctggctgtggcaaaaccactgtgttacgtttagttgcaggtttagaaagccccacagcaggacaaatttttattgacggcgaagatgttacccacaacgcaacgcaacagcgagatatttgtatcgtatttcagtcttacgcacttttcccacatatgtcgattggtgaaaatgtggaatatgggctaaaaatgcagggtgtatccaaagaagagcgaaaacagcgagtaaaagaagcattagagttagtcgatctggcagggtttgaagatcgctatgtcgatcaaatttcaggcggacagcaacaacgagtggcattagcaagagcattaattctcaagcctaaagttctcttatttgatgaacctctaagtagtctagatgcgaatttacgccgttcaatgcgagaaaaaatccgcgagttacaacaacggctcaatatcacttcactctatgttactcacgatcaaagtgaagcttttgcagtgtctgatgaagtgattgtgatggatcagggtagcattatgcaaaaagatacggctaaaaatctctatttacagccaaactctctctttgttgctcattttatgggggaatcaaccattttttcaggaaaacgacaaggcaatcaaattaatatcggtgagttttcttttacccttgaaaatgcagcacgttttcaagtacctgatggggattgtcttgtcggattacgaccagaaagtatccgcttattaagtgatggaactgcagctcaatattgtgaaattaagcaggctgtctatatgggaaaccattgggaaattaccgcactttggcaagggaaaacattaatgattaaccttaacccagaagattatgatgaatcccaaagaaattgttatatagaaataaaaaataaaggggtgtttttgttgaaagataatgcttaatcatattttgactaaaaatctagcattcattcttaatttctaaaaaaagagttgcacggatttttttatcccctataatgcaccacatcagacgcggggtggagcagcttggtagctcgtcgggctcataacccgaaggtcgtcggttcaaatccggctcccgcaaccagttttaaggctcattgttttggttaagacgatgagttttgttctatctaggcatttgaaattgtaaaatgttagataaaacaaaccgcttgaagcctcaactgttgtagtttgaggcttttttgtggctacatagtcagctttgttgtgttaaagggactttttcaagtcctttttttatatctgtcaaatggaggtttccttggcaacattagaacaaaaattacaagagcttgtcgccgatcccattgatgcaatgggatttgaacttgtcggcgttgagtgccaacgtgcaggtcgttttttaactgtacgcttatatattgataaagaaggcggtgttacggttgatgattgtagcgatgttagccgtcaagtgagtgcgatttttgatgtggaagatccgattgcggataaatataacctagaagtatcttcccctgggttagatcgtccattatttacattagcccactatcaacgctttgttgggcgtgaaattgttgttcatttacgcattccaatgttagatcgccgtaaatggcaaggtgaattagtgagtgttgaaggtgatttaattaccttaaaagttgatggcaatttacaggcttttgcctttggcaacattcaaaaagcaaatttaatccccgtttttaatttctaaggaaatcaaaaccaatgagtaaagagattttattagccgcagaagcggtatccaatgaaaaattattaccaaaagatgccatttttgaggcacttgaaaccgcattagccatttcaacgaaaaagaaagcggctgcagaacgtgaagatcgtaaaacgggcaacggcattgatattgatgtgcgtgtagtgattgaccgtaaaacaggagcatttactacttaccgccgttggttagtggtagaaaaagtgcatcaccacactcgtgaaattactttagaagcggctcaatttgaagacccgaacattcaattaggtgactatgttgaagatgagattgagtctatcgcattcgaccgtataacaatgcaaaccgctcgccaagtgatcaccatgaaaattcgtgaagcggaacgtaataaagtgattgaacaattccgttcagaagaaggcaaaattgttatcggtactgtaaaaaaagtaagtcgtgaaagtattattcttgagcttgcaggtaaaaaggacgataccactaaagctgaagcagtgattgtgcgtgaagatatgttaccgcgtgaaaacttccgcccaggtgaccgagtgcgtggtgtactttatgcaattaagcccgagtcaaaaggtcctcaactattcgttactcgtgcaaaaccagtgatgttacaagagttattcaaacttgaagtacctgaaatcggtgaagaagtgattcaaatcaaaggggcttctcgtgatccaggttctcgcgccaaaattgccgtgaaaagcaatgataaacgtatcgatccagtcggtgcttgcgtcggtatgcgtggtgcgcgtgtacaggcaattactaacgaacttggcggtgagcgtgtagatatcgtgttgtgggacgacaacccagcacaatttttgattaacgcaatggcacctgctgatgttagctcaatcgttgttgatgaagacaatcactcaatggatattgctgttgaagcaaacgcgcttgcacaagctatcggtcgtaatggtcaaaatgtacgtttagccacccaattaacaggttggacattaaatgtgatgacaaccgatgagttagaaaaaaaacatcaagcagaagacaataaagtgattaatctctttatggacgctttagaaattgatgaagaatttgctcatcttttaattgaagaaggctttacctcattagaagaaattgcttatgtaccagttaaggaactgacagcaattgatggcttagaagatgaagatctagttgaagaacttcaagtgcgtgctaaaaatgcgatcacggctaaagcgttagcggaagaagaagcattaaaacaggcacatattgaagataaattgttaaatcttgaaggtatggatcgccatatcgcctttaaattagcagaaaaacagattaccactcttgaagaccttgcagagcaaagtgttgatgatttagctgatattgaagaattaaccgcagaaaaagccgcagaattaattatggctgctcgtcaaatttgctggtttagctaaaaacagggagagaaagaatgagtgaaaatgaaatcaaaacagacgcaccgaagaaattaagtttacagcgtcgtactaaaacaaccgtgagcggtacgactgcaggcggtaaagcaaaagaagtgcaagtggaagtgcgtaaatctcgcaaagtggatactgaagcagctaaaaaagtccaagaagaagcactaaaagctaaacaagaagcggaagctaaagcgaaagaagaggctaaaaaagcagaagctgccaaagccgaagaagcaaaaaaagcggtacatcaagtgcctgtaatgccaaataaacaaccaaaaccagcgcaaccaaaagcagaagctcaaccaaaacaagaaaaagcggttgatcctgaaaaagaggcaaaacgtaaagaagaagctgaattgcgtcgtaagcaagaagaagtggctcgccaaaaagcggaaatggacgcaaaacgtgcagcagaaaatgctcgccgtttagcagaaaatgctcgtcgtttagcagaaattgcccgtgaagaagcgattgaaaatggcgaagactatgaagatgaccgctttacttctaaatatgcgttagaagcagaacgtgactctgagcgtcgtagtgaaggcaatcgtggacgtggcaaaggcggtgtagcgaaaaccaaaaaaggcggacgtgatgatgaaaacggcagtaaaaatgaacgtcaatctgaccgccgtaaccaaaaagataccaaaggcaagggtaaacacgcgaagaaaggctgtgcattacaacaagccttcactaagccagctcaagcagttacgcgtgatgtggtgatcggtgaaactattactgtggcagaacttgcgaacaaaatggcagtaaaagcgaccgaaatcatcaaaacaatgatgaaaatgggcgaaatggtgaccattaaccaagtgattgaccaagaaactgcacagcttgttgcagaggaaatgggacacaaagttattctgcgtaaagaaaatgagttagaagaagcgatcttagaagatcgtgacttacacgcagaaaaagtaacccgagcgccagttgtgaccattatgggacacgttgaccacggtaaaacctcattattagactatatccgtaaagcgaaagtagcagcaggtgaagctggcggtattactcagcatatcggtgcatatcacgttgaaaccgacgacggtaagatgattaccttcttagatacaccaggacacgcggcatttacctcaatgcgtgcgcgtggtgcgaaagcaacggatatcgttgttcttgtagtagcagctgacgatggcgtaatgccacaaaccattgaagcaatccaacacgcgaaagcagctggtgcgccgattgtggttgcggtaaacaaaattgataaaccagaagcaaacctagagcgtgtagagcaagagttattacaacacgaagtgatttctgagaaattcggtggtgatgttcaatttgttcctgtctcagcgaaaaaaggaatggggattgacgacttacttgaagccattcttcttcaatcggaagtattagaattaagtgcggtaaaagagggtatggcaagcggtgtggttatcgaatcttacctcgataaaggtcgtggcccagttgcaactatccttgttcaatcaggtacgttaaacaaaggcgacatcgtactttgtggctttgaatatggccgtgttcgtgcaatgcgtgatgaaaatggtaaagacattgaatcagctggtccatcaattcctgtggaagtattaggactttcaggcgtaccagccgcaggtgatgaagcgacagtggtgcgtgatgagaaaaaagcgcgtgaagtggcgttataccgtcaaggtaaattccgtgatgtgaaattggctcgccaacaaaaagcgaaacttgaaaatatgtttagcaatatggcggaaggcgatgttgcagaattgaacgtgattgtgaaagcagacgtacaaggctctgtagaagcgattgttcaatctttacacgagctttcaacggcagaagtaaaagtgaaagtggttggctctggcgtaggtggtattacggaaaccgatgcaaccttagcggcagcgtctaacgctattgtacttggctttaacgtccgtgcagatgcctcagcacgtcgcattatcgaaagcgaaaacattgatttacgttattattcaatcatttatgagctattaaacgaaatcaaagcagcaatgagcggtatgttacaacctgaatttaaacaagaaatcatcggcttggcagaagtgcgtgatgtcttccgtcacccgaaattcggtgcaattgcaggttgtatggtcactgaaggtatcgtcaaacgtaacaacccaatccgtgtattacgtgataacgtcgtaatttttgaaggcgagttagaatctctccgtcgtttcaaagacgacgtttcagaagtccgtaacggtatggaatgtggtatcggcgtgaaaaactacaatgatgtaaaagtcggcgaccaaatcgaggtattcgaagtggttgagattaaacgttcgatttaatctattgatattagggcaaatgtcatttgcccctacaaatttaacggcataatgatttctcgttatgccgttatttttttattcttccaacaaaaatttctgttagaataaatgcaaccctattcagcattggaggtaatatggctcaaatttatattcaatcggattactttcatcaacaaatggcgtgtattgtgcaagcaattcaatcaggaatggaaaaacaagcactaatttcttacgttcaaaacgtagaaaaacaaattgccgataaggtggaagagcctgcatttaactacgatctagaaagaatgaaagcacacgttgaaagtgaaactattgaaatgccttcggacttaacaagtgcaaaagcaattaaggagtggttacttaatggctaacttgacaattgaatatggctcactttttcgtaaagaatttgccaattttccagtaaaagaccaagatgcgatcgttgaattcgttgagcatattcaaaattttggctttaccaaccttgaaggcaggaataaatcttccgacaacgtgcataaaaacgatccgcactttgctcaaaaagtaaaatatgcacgagaaaatcatctatggcattaccacattggtatccttgcctttgatttaagtaaaccttttggcgatagaacgtctgaatatgtgctgcattatcagcgttttagtgatcgaataaaaatagtcgattattcagctcacccgccttttaatttacccacagcttcttaccttagataaatgacattactggtatcctttaagagtggaaaaagtgtcagtttatgtaaattcaaagtcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacaaccagcggttggcttatgggaaggtacgctgaaagtaatgggtacaagcggtgagattaagacttccgcaagcggtgataccatcacattgaaattagatgaaacattgaaaaataaaattgataggattgacagtttaggttggaaacttaaaattgctcagggaagggggggtgaagcaacaaatcaacctgcggaacatcttgtcaaaatgagcgatatggcaaccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacgaaaatattacgatttctacgcttggtaagttaattaaagaaacgcaaaccttagcgggtggcggtttgaaaattacttatactgataatacatccgatactattagcggtggtgcaccaggtcctgcgggcccaatgggtccaaggggtgaacgaggagaacgaggactaacgggtccagcaggaccacaaggtgaaccaggtccagcaggtccagtaggtcctgcgggtgcagcaggtccagcaggtcctgcgggtgcaagaggtccagcaggtccaacaggtcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagagcggtcgcatttggtaacagtacattagctggcatacaatcggtggctattggtaacgttgcaattgcttcaggcgaaaaatcgatagctattggtgataatgctaaggctgtgggcaaccaatctatctctatcggtacgggtaacgtagtgaacggcaataactccggtgcatttggtgacccaagtgtgattaatgctgataactcttattctgtgggtaacaataatacgattgagaacgaaaatgtctttgcattgggtaacaagattaccaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcgaggggaagccacgatcagatgttgtgcttgtgcgatccgttttgccacgatagaactatcttcgagcttaccgatacgcaaaacaagatcataaccctcagccacgacatcaacacgacggtcgctaaattccaaattcagttgcagatgtggataggtttcggtaaaacagtgtaaatgtggagcaacaaaacgagagccaaaatccatcggcaacgacattgtgagcttcccttgtagtgttgaggtaatgttcgttacacaggcttcagcgtctttgagttcgtttaaaatgggctggcagcgttgataaaaaagcaaacctgcttccgttgggctgatacggcgtgtggtacgttgtaataagcgaacgttgaggtgttcttctaattgagcaaccagtttactcgccatcgcaagagaaatctgttcttgctgtgccgcttgggtaaaactttgggtttcaatgactttacaaaagaggtttattgcgttgagtttatccatagatgttagcttgatattgtcttttagggaaatgcttgctattgttacaaaaattttgatgcaattcaattttaatatttacttttaagaaataatttcaatattatttatattattatttaatttaggtattctcaatgggaaaatcattagtaattgtcgagtcgccagctaaagctaaaacaattaataaatatctaggcagtgactttgtggtgaaatcaagtgtcgggcatatccgtgatttaccaacaagcggtgcggaaaaagaagaaaaaaccgaaaaggccaaagcggtttcgactaaaggtatgacggcagaacaaaaagccttagtaaaatcagagaaagaacgtaccgctttagtgaagcgtatgggcgtggatccttatcacgactggaacgcaacttaccaaattttaccaggtaaagaaaaagtggtttcagagctgaaatcccttgctaaaaaagccgatcatatctatctcgccaccgacttggatagagaaggggaggcgattgcgtggcatttgcgtgaggtgattggcggtgagagcgagcgttttagccgtgtggtgttcaatgaaattactaaaaatgcgatcaaacaagcctttgaaaagcctgaacagctcaatatggatagagtaaatgctcaacaaacacgtcgtttcttagatcgtgtggtgggctttatggtgtcgccgttgctatggaaaaaagtggctcgtggcttatcggcagggcgtgtgcagtctgtggcggtgaaattgttggttgagcgtgaacgtgaaatcaaagcgttccagcctgaagaattttgggagatcttagccaaaacctctgcgaaaaaaggcgatctggcgttagaacttgtacagcataaaggcaaaaaattctcagtgaaaaaccaaaaagaagcagaacaagcggtaaaatctttgcaaaattctgcatttatcgtcactgaaattgataaaaagccgacttcatcgagagcaaaagcgccgtttatcacttccaccttacaacaaacggcaagtacccgtttaggctttagcgtgaagaaaacgatgatgttggcacagcgtctatatgaagcaggctacatcacctatatgcgtaccgactcaactaacttgagccaagatgcattgacgatggctcgtagctatatcgaaaaacaatttggtgagcgttatttacctgaaaaaccgaatttttatgccagcaaagagaaagcgcaagaggctcacgaagccattcgtccgtctgatgtgatggtgaaaatgcaagatctaagcggtatggaaaaagatgcagaacgcctatatgacttgatttggcgacaattccttgcttgccaaatgactccagcggaatatgactcaactagtttaacggtaacagcaggggattacgaactcaaaaccaaagggcgtgtattacgttttgacggttggacaaaagtactgccaattcaaggcaaaacagcggaagatcaagagttgccagaagttagtttgaatgaaactttgaaactgaacgccgttgaacctagccagcactttaccaaaccgccggcacgttatagcgaagcggcgttggtgaaagagttggaaaaacgtgggatcggtcgtccatcaacctatgccgccattatttcgaccattcaagagcgtggctatgtgcgagtagaaaaccgccgtttctatgcagagaaaatgggtgaaatcgtgacagatcgcttaaacgaagcctttagcgatttaatgaactacgattttacggcaaatatggaagatactctcgaccaaattgcgtcgggcaatagcaactggaaagtcgaattaaaccgcttctttgccgatttctcagaaaaattaaccactgcagagcttgatgaactggaaggcggaatgcgttcgaataatctagtggcaacagacattcactgcccgacttgccaacgccaaatggcgatccgcaccgcaagtactggtgtgttcttaggctgtacaggctatgctttgtcacccaaagagcgttgcaaaaccacgatcaacttaattccagaggcggaattgctgaatgtgttagacgaagattcggaaactaatgcattaatgaaacgcaaacgttgcccgaaatgtgatacggcaatggatagctatgtgatcgatccacaacgtaaaattcatatttgcggtaataacccgaactgcgacagctatgtgattgaagaaggttctttcaaaattaaaggctatgacggcccgattgtcgaatgtgacaaatgcggttcggatatgcacttaaaacttggacgtttcggcaaatatatgggctgtaccaactgtgacaacactcgcaaaattctcaaaaatggcgaagtcgcccccccacgagaagaaccagtggcattcccagagttaaaatgcgaaaaatcggacgcttattttgtgctacgagatggggcaagcggtgtgtttatgtcggctcacaacttcccgaaatcccgtgaaacacgtgccccgaaagtggcagaattagccttataccgtgatcgtttgcctgaaaaactgcaataccttgcagacgcaccacaacaagaccctgaaggcaatgaagccattatccgttttagccgtaaagaaaagcgtcagtatgtgacctctgagaaaaacggcaaggcaaccaaatggattgtggattaccttgatggcaagtggatagaaagacatagataaaggtagagggctaagtctggtggaatacgatacttagccctttgatttatttttcaataaatagattactttgttgaataagttgtaaaaacagggcgagtggcggacggctagtctgtttttcgccttgtagatcaaaatgttcaaaatcgcctttacggttgatatgaaattgctcaccatttggcattatcgctacattccatttatagtttgaggctagaagccattttcggctattttctttcgttaaatcaataccttgtgcataatcgctaattggcgatgttaccccgaagaactggcttaacagtgttggagctatgtctaaatggctagaaggtaagctataggtgcggttatcactttgccagtagataagcattggtacttggatccgagcttgtgcaaaactgttgtcgctagtgaccgcttgttcagcaatatcagaggtaatcacaattaaagtactttgggctaagccttgttgttcaagggtttgccaaatatcattgaactgccaatctaaatttttgctttgttgggcatagtctatgcctgctggaagttgtagatctagatagctaaaaaatgcgttgtcgctacgtttgccgatccagtttttccatttctcaatggcttcaagattgctttttgttttaggtaatttgaaatgggcaaataaggctctgtggtaaatcggttctgcaaagccgttgtgtgaaaatagcccaaattggtagtttagctgttgtaaacgagcgatcagtagcgaaggggctttttcgttcaaaattgcgtctaaatagcgtccacttaatccgtaaaatagtccaacgatgctaccgcttaggctatcactgctgttgtaatgttgggtgaaacggcgagcattttggctgacttggtaaagcgatggcattgtttctgcggtaatcgcttcattttttaagccagagagattaatgaaaagtacattaggcttatgctgtggttcaacaaattgcaaggctttgcgcgggtagttgagataaaaggtgtctaaccgaccgctttcttcgatctgctgttctaatactgcacggtcgataagtccgtgtttttcaaggaaactgcgtgcagtcattgggtaggaaagcggatagtttgctttttgggcggtaatcgggcgatatagggtcatatccgcccacgcatagagtaaatgggtagctgtgaagcaagctagaaacagcattgcaacatattttccccacttctggcggttgaaactacggagcttattccaacaccaacgagagtaaagcatttctgctaataaaatgagtggcattggcacaaaaagcaattgccattggcgtgtcagttcgccgtcgtcgttaggattgactaacagctcccaaacaagcggtgacaaatggaggtaaaaacgcttaaagacttcggtatcaactaataggatcgtcattccgatagtcgcaaatatcactgaaatactacggaaagcacggttatttttaatcagaaagctcagaggaaagagcaacagcagatatagtgcaaagacgacaaagctaaaatgcccaaataagctaataaaaaaatagagcttgccgaaaagggtgtttggccagtcggcattaaaggcatagcgagaggaaatcagcaacgtcacaacgatattaaataacgcaaaccagtgaccccaactaatgcgttgtgagatctcttctcgatattgccgagaattttcaggaagaaggtagcgaagttgatttaacatattattttgccgattttaatgagttttttaaggcagagctaaatgcctcagcaagcacttcacgttgctgtgggctttgcacgttggtgactaaaatgttcgttatcatattccccaaagccattaacgagagatcgactggggctttgtgtttttcaagggttacaataagatcgtttaatagtgcttcaatttgtttatcttgatattttgatttggttgccattggagttacatcttaaaaaataaaattggtgggaatagtagcataaaagtgatttacaagcggtgagttttacgcaatttttcaatattattttggtttttaagtatggaaaacgtctagcgtttgcaaggggaagtcttatttgggagaactatgttgacgtccctgtccttttgggtatgggggacgtcaaagtgagtgttttagttgttcatatagctctggtataggatttcccagtcttgtgggtaaaaatggatagataatcttcctttctctttattaaaagatcgcaatagccgatccaaattgccttgcttccattcattcccttgctggatttggcatttatcaaaatcaatcagccaaaatattccttgattgtcgatcaaaatattatgaatgttgagatctgagtgatgaacttgatgatcgtgtagcaggcgaatcagttgcccaatctgctgatattgtgctggtgttaagctctttgtttgtagatattggctcagatcttgggtatctgcaattttttctaacaaaatatccgcttgatagaaacaacattgacgtttcactctaattgcaatcggccgaggcactggaatttgccattgagagagctgggcaagcaaacgaaattcttgcattgctcgtgttttttcatagctttgaaaaaaataacgatctttgacaaacttgccaaataacccaccacgataataatgacgaagcacgctatttacaccgagttctttttcggtgttgagaaaccaagttgtaccacgcccttttgatgaacctaacaagcggttggattgactgaaatctttgcaatctagtaattgctgcacaaaagattgtttttcatcggcgacaagttgagtattaaaatggtaatacatattttattattctctttttgatgtaattgcgattctacacgatttttgtggattgcgttgtatttttaaggcaatttggtagaatctttcgcctaaatttttagaggaacatcaatgagcaacatctctccagaagcccaaagtgtacgtgatgcacttcttgcaaaagggattgaaaccccaacggtttgccatcagaaagataaagattctcgtcgtaatgaaatccagcaacatatgcgtgctgtccttgaattattaggtttggatttacgcgacgacagtttagaagaaacgccgcatcgtttagcgaaaatgtatgtggacgaaatctttagcggtttagattatgaaacctttccaaaaatcaccaaaatcaaaaaccagatgaaagtgagcgagatggttttagtggatgatattaccttaaccagcacctgtgaacatcactttgtaacaattgatggtaaagtggccgtggcgtattacccaaaagattgggttattggattatcaaaaattaaccgtgttgtgcagttttttgcgcaacgtccacaggttcaagaacgttttaccgaacagattttaacggcatttcaaaccattttagaaacagaagatgtggcggtttatgtgaaagcaacccatttctgtgtgaaatgtcgtggtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatactcgcaaagagttcttatcgttaattaacaaataagtgtttggtatagtgcttaattatgtctatggaatataacattactttcctcgatcatcttatgtgatgtgtgattaggtagaggtagtaatgctgaaataattaataggcaagtattatttaaagtaggtacaaatattgtaagttatgaaatttattatcaaacttttccctgaaattatgattaaaagcgattccgtgcgtaaacgctttatcaaaattttaacctccaatatccgtaatgtgttactgcgtgaaacagaaaatgtggcagtaattcgcaactgggattttattgaagtgcgagcaaaagccgttgaagaagctcctctcgtattggatttactcaagcgcaccccgggtattcatcatattcttgaagtagaagaaatgccgtttaccacaatgcatgacatttttgagcataccctagcgaaagtaaaaggggaattagagggtaaaaccttctgcgtgcgtgttcgccgtaaaggtaagcacgatttccgctcgcttgatgtggaacgttatgtgggcggcggcttaaatcagcatatcgagtcggcaagtgtgaaattgactaaccctgatgtaacggtgcgtattgatattgaccaggataagatgttgctcatcaaagctcgccacgaaggtttaggcggttatccgattggtacacaggaagatgtgctatcgctgatttctggcggttttgactcaggcgtatcaagttatatgctaattcgccgtggttctcgtgtgcattattgcttcttcaatcttggcggtgcggcgcacggaatcggtgtgaaacagatggcgtaccatatttggagccgttacagctcgtcccataaagtccgttttgtggcgatcaactttgaaaatgtggtcggtgaaattttagaaaaagtcgataacggacagatgggcgtggtactaaaacgtatgatggtgcgtgctgccagcaaaattgctgaacgttttgatattcaagcaattgtcacgggcgaagcattagggcaagtatcaagccaaaccttgacgaacttacgcttaatcgacaagacttccgatactttagtgttacgtccgttgattacccacgataaagagcaaattatcgcaatggcaaaagagattggcacagatgatattgccaaatctatgccagaattttgtggcgtgatttcaaaaaatccaacagtaaaagcgattgaaagtaaaattatcgaagaagaagggaatttcaactttgacgttctcgaacaagcggtacaaaacgcccattatttagatattcgtgagatcgctcaacagaccgaaaaagaagtagtgtccgttgaaactacttctgaattaggcgaaaacgatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactacttctgaattaggcgaaaacgatgtgatcttagatattcgtagccctgaagaagtggacgaaaaaccgttcagccttgaaggagttgaagtcaaagagctaccgttctataaactctctaatcatttcggcaacttagatcaatcgaaaacctatctgctctattgccagcgtggtgtgatgagcaaattgcaagctctttatttgaaagagaatggttttagtaatgtaaaagttttcagtatcctctagttattttaattaaggagttaatatgactcaactaagcgttgtgattttagcagcgggtaaaggcactcgtatgtattcagatttaccaaaagtcttgcacccgattgcaggaaaaccgatggtaaaacacgtgattgatacagcaaaacagctgtcggcaaaacaaattcacttaatttatggtcacggcggtgatttattacaacaacgcttatctgcagagccagtaaattgggttttacaagcggagcaattaggcacaggacacgcaatgcaacaggctgctccattttttgccgatgatgaaaacattttaatgctttatggcgatgcccctttgattacagcggcaactttagagaaattgattgcagctaaacctgaaaatgggattgcgttattaacagtggtattggataacccaacgggctacggtcgtattatccgtgaaaatggttccgtagttgcgattgtggaacaaaaagatgctaaccctgagcaattaaagatccaagagattaatacaggggtaatggttgcaagtggcgctagtttcaaaaaatggttatcgcaattagataataacaatgctcaaggcgagtattacattactgatgtgattgcaatggcaaatcgtgatggttacaaagttgaagctgttcaagcaacaaatttaatggaagttgaaggggcaaataaccgcttgcaacttgctgctctggagcgttattaccaaaaaatacaagcggaaaaattgttattggctggtgtgacgatcattgatcctgctcgttttgatttgcgaggtacggtaacgcacggtaaagatgtggttattgatgtgaatgtgattttagaaggctctatccagttaggcaatcacgttaaaattggggctggcagtgtgctgaaaaatgttgtgctaggtgataatgttgagattaagccttattctgtcttagaagatagtgtgatcggcgaaagcgctgatgttggcccattcgcacgtttgcgtccaggtacagagctggcagcaaaagctcacgttggtaactttgtggaaatcaaaaaatctaccattggcgaaggttcaaaagtggggcatttaacctatattggcgacagtgaaattggtgcaaatgtgaatattggcgctggcactattacttgtaactatgatggagctaataaatttaaaactatcattggtgataatgtgtttgtcggatctgatactcagttagttgcccctgtgactgtcgcaagcggtgcaaccattggggctggttcaaccattactaaagatgtggcggctgatgaactggttattacccgtgtgccacaacgccatattcaaggttggcaacgtccgacgaagaaataattcattgtactaggaaaatcctcttttggtgtaaaagaggattttttatcaactctgtgccgtaaaactctgcttgcaagatgcagggatatgatgtgtcaagaatctatgctgttttaatcttcattgatatgagcgttgagaatgttgggacatggggtttatagtagtaatcatactattataattttagtattatatttggtaatatatttcgcacttttccgcaaatgtaataatgctaaaaagccgcagaatattaccgcttgtgagaaatggtgtaggtgttttatgaaaaagtatattaccttatttgttagtttatttttatccataacaggatttgctcagccattatccacaccattagcttatttgactgcaatgaataaagctcatcaaaccttaaattatgaacagctttacatttttcaaaaaggcgatgatgtaacctctttacgctatcgacacgcctatgataacggacaagagtacgctcaactactacatcttgatgccacaagagaagagatgattttaagggaagatgtggttgggtattttggtgattatcagccgttcagtttaaaaacaccccatattttagatgatttcccaaccgttgtttatagtaatttttctcagcttgagggctatgcgtttttagataatggcaaaagtcgtgtggcagatcgtattgcaagggtaattcggattgtgccaagggatgatttccgttatcaatatatgttgtggatcgatgaggaaaattatctgctgttgcagagtcacttgttggatagagataataatgtgttagagcaatttaggacaattcaatctgtggtaggtgatcaattattgtacattgtggaaccgattcgtacattaattcttccaacgctgttgcaaactaaaatacattcggaactaaaacctttagaatggcaactaaaatgggtacctcgtggatttaagcaggtggcttcaggacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgaatttaagcaggtggcttcaggacaacaaaatttgtctgaggtgttggctcaagatgagcagatcgaaagtcgattatatagtgatggtctgttctcttttacggtatatcttgtgcaaaataaggggatttcatttcaagatcagttttggcgtgagggaaaaaccagtgtttacagccagacaatcggggataaagatgtgattattgtgggcgaaattccgttggcatcggcacgccatattgtgcaagagattgagtttagttcacaaggtgaagaacaatgatgattgaacaagccactgttattcagtatcaaaatggaattgctagagtgcaatgccaagcaaaatctagttgtggcagttgtgtagctcaaagccattgtggttcaaaagccctttctgcattggcgggggaaaaatttgcaccgcaatttgatttagtggttgcaatgcctttgcaagtcggtgataaagtgaaaattgggttagccgagagaagtttgttagaaggtgttttttggttatatgcggtgccattatttgtgattgtgttatcgacgttggttttatcgcaatggcttaaccatgaattatgggtggctgctggggtgttgtgtactacggcagtgactttttttatgattaaaagagctattgctcaaaaatctcaggctcagtttattcctgtatttttgggtaaagtttaaaggagatgtaatggaaaaaatttggtttgataattatccagcagaggctgaacgtaccttagatgtggagccttacgagtcgttggtggagatgtttgaaaaggcggtacaacgccaccctgatattcctgcttatattaatatgggtcaggtacttacatttcgtaaattggaagagcgtagccgtgcttttgctgcatatttgcaaaatgaattacgccttgagaaaggtgaacgcattgcgttgatgataccgaatttgttgcaatatccgattgcgttgtttggtgcgttgcgtgcagggttagtggtggtgaatgtcaatccgctttatacaccgcgtgaattagagtatcaattgaatgatagtggagctaaagcgattgtcgtcgtgtcaaattttgcggcaaccttagaaaaagtggtgttcaatacgcaagtgaagcacgttattttgacccgtatgggcgatcagctctcttttggtaagcgtacgctagtcaactttgttgtgaagtatgtgaaaaaattggtgcctaaatataaattgccacatgcggtcagtttccgtgagacattaagtatcgggaaacagcgtcaatatgtaagaccaacgctctataaaaatgatctggcgtttcttcaatatacaggcgggacaacaggagtggctaaaggggcaatgctaagtcatagcaatgtgattgccaatattcttcaagcgaaatgggtagcctatcctttaatccaacgaagccaagagcgaattggggtaattgctctgccgctctatcacgtttttgctttgacagtgaattgtttattatttatcgaactaggtgtaacggggttgttaattactaaccctcgtgatattccagcttttgtgaaagagttgaagaagtatcctgtgatggcgattacaggggtaaatactttgtttaatgcgttactgaataatcctcaactgaaagaagttgatttttctaacttgaagctctctgtaggcggtggtgcagcaattcagcgtgcggtggcggatcgttggcataagacaacggggtgccatattattgaaggttatggtatgaccgaatgttccccattgattgcggcaacacgtaacgattctacggagtattcgggatctattggtgtgccggtaccaaataccgacattcgtattgttgatgatgctggtaatgatttaccgataggtgagcgtggcgagttatgggtaaaaggccctcaagtaatgcaaggttattggcaacgccctgaagataccgcagaagtgctaaaagatggctggatggcaacaggtgatattgttgagctgggacaagacctcaatttacgcattgttgatcgtaaaaaagatatgattattgtatctggttttaatgtgtatcctaatgagatcgaagatgtcgtagcattacatccgaaagtgaatgaagtggttgtggttggtattccaagtgaagtatcgggtgaaagtattaaggtctttgtgactaaaaaagatgaaagcctaactcgtgaggaactgcgtaatcactgtcgccaacatttaacaggctataaaattcctcgagagattgaattccgtgatgagctaccgaaaagcaatgtaggtaagattttacgccgtgtgttgcgagatgaggaagttgctcgagtgaaatcacagatggaaggaaaattgtagtgagaataagtggtatatctgcggttgagatataccactagtcattatattaatctgaattaaggatctcttttgaaattaattaaatattttgctctgattgttttagtgtatgctgttccaacgctgtttacagaaacgatggctggtgatttgtctaaaattcagcagaaaagtcaggcattaaaaaacaaaattgatgagcaaaagaaaaaacgtgatagtttgcaatcgacattaaaaaatcaagaaattgaaatggggaaagtccttaatagtttaaaacaaacagaaatgactttgtctgaaacaagggcatcgattaaacgtacagaacaagagatcaagcggttagaaaagcaggaagcggtacaaaaagagaagcttaaggaacaattggattctgcctatcgttcgggtattcacccttcagtcttagagagattgttatccgaagaagccaaaaatgcagatcgaatgggggcttattatgagcatatcaatcaagtgaggattgatgcgatctatgagttacgtcgcacacaagcggatcttaaagctcgccgagatgagttaaaagagcaacaaaaagggcaacagacgcaacttaataaacagaagaagcaagagaaagatttgcagaaagtcaaaaatgaacgtgaaagtacattgcgttctattgataaaagtttagctcaagatcaaggtcatttagaaaatctgaaagcgaatgaagaggcgttgcgaaatcagttggtacaagcaagcaatgagtctgaacagcaagaaaaacaagatattgcgaaacttgaacagaaaaagaatacggaagaacgtcgtagcgcaacggaatctgaaaaacagcaagttcgggcaggtaatggcttatctgggaaatatcgtatgcctgtttctgggaaaatcatcaatcgctttggctcaacacagatgggtgaaattaaatggaacggcgtggtaattcaagcaagtgcaggcacacctgtaagagcaatagctggtggacgagtgattttagcaacttggttgcaaggttatggggaagtggtcgtgattgaacacggtaaaggcgatatgtcgttgtatggctataatcaatcagtcaatgtgcgtaaaggtgagcgagttcaagcagggcaggtgattgcaagcgttggaaactctggcggtcaaagtcgttcagctctctattttgaaattcgccgtaaaggtgtggcggtcaatcctttgaaatgggtacagtaaaatgaacaaatggataaacaagcggtctattattttgttgcttttgcaaattttcgggctttttgcaccgcttgcttatgcgaataaattggtgatcgttattgatgatattggctatcgaataaaagaagataatgccatttatgccttacccaaagaggtcaatgttgccattattccttctgcaccttatgccacagtccgagcaaataaagcgaaagaacaaggacgagagatcttaatccatttacctatgcaacccaaagtgaaacagcctattgaagctggggcattattagtgggaatgggggaaagcgaggtgagtgagttaattcatcaggctcaacagcaagtgccttacgccattgccttgaataatcatatgggtagtaaagcgactgcggataaaacgacaatgcaacacttgatgaaagccttatcacagcaaaggttgggttttttggacagtaaaaccgcaggggatagtgtggcttatcaaacagcaaaagcttatgggttaaatgcattagaacgccacatttttttagataatagtgatgtgtttgctgatgtacaacggcaatttcaacacgccgttcaatatgctcgcaaacacggtattgcgattatgattgggcatcctcgtaagcacagtatcgccgtgcttgaacaggggattgcaaatttacctgcggatattcagttggtgagtttgagtagtttatggaaaacggaaaatgtcgaaccagttaaaccatttattatgttgtttgagattgaacctgctttaacctctaaagcaccttatcgggcagtgccgttattaagagggatacctcaggaataggtttatgttaatttaagtagaataacacgatgaaaacaagattatctttttgttcgttattagttttaattggtatagcgaatgcagagcaaacagtgttacttgaagttgatgggatcaaagataaagatctctatcaaaatgtgcgtatttacctctcgcagttaagcaacgatgatgcggacagctcagaacgttaccaacagcttgtacaagaaactgtcgataaagccttacgagcaaagggatattacaatactcaatatcgctttgaactaacccctcgtacttcttctaacaaagatctcttaacgctatatgtacaattggatcagccagttaaattagatgagcgtgaaattaagctcacaggacaagccgagcaagacgatgattttaaacggttattagccaaagaggttccgccaatgggaaccgtgcttaatcacgaaacctacgataattttaaaagcagtatagaaaaactctctcaaacaaacggctattttgatgggcagtggttgtatcaccgtttagaagtccatccgaaggaatatcttgccgattggcgattgggctatgatagtgggaaacgttaccgctatggcaaaatagggtttaaaggcaatcaaattcgagaggaatatctcacgaatatattgcgtattaagtctggtgactattattatttgaacgatttatcgatactatcgaacgatttttcttcaagtagctggttttcatctgttttagttgaaccaagtgtaaagcagccctcaaaagaggtggatttagacatattattaatacctaaaaagaaaaatgatattgaagtggggattggctatgccacagatgttggtcctcgtttgcaatttaactggaaaaagccttggataaacgggcgagggcatagtttagagctaaatagctatttatctaagcctaaacagagagtggagtttggttacaaaatgcctgtaaaggcacagccacttcattactactatcaggtgtcaggtggtcttgatcgagaaaatcaaaacgatacccaatttacaggggcatattctgcttttcagcgtttctggaaccacgaaacaggctgggcgttctccttcggggttaaaacccgttatgatgcttttaggcagggcagtgataaatttaagacctttttgctctacccaacagcctctctaaatcgcacgcgttctgatggcagacgctttcctttatggggggatagccagaaagttaccatcaattttggggataaagctttcatatcagatgtgagtttttacagttttaaggcttcaacggcgtgggtaagaacctattttgataatcatcgtatcgttgcaagagcagaggtcggctatttaaaatcagcggaatttgaacgtattccaccttccttacgttattttgcagggggggatatgagcgtaagaggttttggttacaaaaagatttcccctaaaaataaccaaggtaaactaacagggggatcgcatttagcaacaggttctgttgagtatcagtaccaagtgtacccagattggtgggcggcaaccttttacgatacgggcttatccgataaaaaattcagtagcaaaaccctacattcaggggcaggaattggtgtacgttgggcttcgcctatcggggcagttaaatttgacctggcaatgccagtacgctcaccagataataaaaaagggctacaattctacattggcttaggcacagaactttagtgagataatgttatggaaaaagagcaatctttagcacaatcacccaatgatacagcagtaaaaccccacaacacaaaatggcgttggttatggcgtggtttatgtgtgctactgattttgcttttattgcctttagcttttcttgcaacaggaatggggcaaagaaccgctttaacccttgcagataaatggttagatccgctttcgattggcaaagtggagggaagcctacaaaatggcttaacgcttacggatactgcgtatcagctcaacggggtcaatgttcaagttggacaagcggaattacatttagatttgagttgcttattggcatattccgcctgcgtggaaaaaattgcaatcaaagacacacaagtggcggttgataccagcaaacttcccccttccacaccaaccaaacaaacaagcggtgagtttaatcttccaattggcgtatcgttaaaacagataagcatagacaatgtgaaggttcaagttgatgaacttaatattggcttacagcatttccaatcgggcattcaaggaaaagggaagagcctttcattatccccaactcaattacaaggtttaactgtttcccttgcaccacagcaaactacggaaaagcctcaaaaagtcgctgaaactccctctcagccgatagattgggaagccttaaaacaacagcttgcacagccgatcttaaccaaattagatcctattcaattacctgttaatctctctgtgccggaatttcaagcaaaacaattgcagttgagccagaaagttaagaccgctaaaggtataagcgaaaaatcgctattaaaaatcagtttgcttgagttacaagcgaaatctgacgaacaatcggtggaattgcaaaaactcaacctgcaaagcgacaaaggcaccatttcaggaattggcaaactcaccttgtcaggtaattatcctttagattggaagctcaatgcccaaattccacatttaaaagagcttgcaatcccgacaagtcaggcagagcttattttgtctggggaactctttggcatcgcaaaattagatctcaaaacaagcggtgcttttgaagcaaatattcacagtactttgcaattttcggaacctaaaacaccgcttgatctcagtattaaaagtccgaaattcagctatccttttatcgcagggaaaggtaaagatccgcttgtctttgaaaaaatcgacctcgctttaaaaggcgatctactcaattactacttaaacggtagcttatccgccaaaggtatgaacattccctctgcagatttaagcctaaaagggcagggggaattaacctattttgcagtcaatgaagcattgctcaacgcactacaagggcaaaccaaattcagtggcaaagtcgattggacaaacggcttagaatggcaatccaaccttgccttacagaatgtcaataccaaatccatttttcctgaatgggttgcgttactatcgggggaatttcgttctcaaggctttgttgggcgaggtgaaacaggcaatgaatgggcggttgtgctagacaatatggatttgcacggcaacttacagcaaaagcatttacagttaaaaggcaccttgacagcagatcataacaccttactcaatatccctgaagcaagtttaatttatggcgaaaaccgcattgtaatgcaaggtgttttaggcgaaaaatctgatttcaatgccaccattaaagccccgaatttacaaggtttaatcccacacttaaaagccaatatcaacggacaaattaagctacagggaaatatcaatgaacctagtttagatctcgatcttatcgctaatcatgtagcctatgatcaatttcagctacaacatctcaatgccaaagggaaagtaagcaccgcacaacaagtgcaaggtgatctcgaaataggcttgcgtcaattaacttacggcgaaataacgctagagaatgctaatcttacagcaaatgctagtgaagcaaatcatagcctgaaactgaccgctaaaggaaagcctgtgggtatccagcttcacttagcagggcagtttgatcgtagcaaacaacaatggcaaggtgaactaagtaatctcaatatccatacccctgttggcgaatggaaaaatgataaaaatctacaagttagctatcacaatcaagaacttaaagcagatgtttccgcacattgttggcgaaatccaaaagcagcgctctgcttgtcacaaacatttagtgcgggtaaagaggggaaagtgtcgtttgaaatcaaacaatttaaccttgaaatgctacaagaatacttgccgaaagagagtatattaacgggtatcgtcaatgctaaaggtgatgtggcttggtttagccaaaaagatcccgaagttaatgtagagctactttcaaatagccttaaatttacacaaaaactgaacggacgcagtttccctctgtccctttcatcattgaaattaaatggcaaaatcgcagaaaacaatttgagcttggatagcgatattcgcatagaaaataacgggcgtttaaccagcaagctactgatgaaagaacttaccaaacagcgaggactgtctggcaacatcaatatagatcagctaaatttacgtttaatcgaaccgctacttagcacagatgaaaaagttaatggggatattaacgctcgtttaacactgggtggaacagctctatctccacaactgctaggcaatttaaacttaacagggctacaagtgcattctaaatcaatgccatttgatgtaacaggtggaatgcttgccttaaactttaaaggtgcaagttcaaccttaaaaggcaatattcaaacgaaagaaagccaactattacttgaaggcgatgcaaattggcaaaaactagaggcttggcatacacgaataaaagcacaggccaaccgcttccgtgttgatattcctaatatcgccaaagttgatctcagcccacatattgaagtaaaagctacgccaaaagagttaatccttggcggaaatattgatattccttgggcaagaattgccgtagaagaactacctaaaagtgctgtcaccatcagtagcgacgaagtgattatggacggatcagcaaaaaacaagaacaaagctaccgctttactgaataaaaacttgcctcaaaataacaacggaatggcaatcaaagctgatgtcgctattaacattggtaacgacgtaaaattagatgcctatggtcttaaaacagatctaaacggcattatcaaagtccaacaaggaaatcgaggattaggtttatatggacaagttcatttaaaaaacggcacctttgcctcttttggacaagatctcgtaattcgtaaagggcttatatcctttactggattgtcttcccagccaaccctagacattgaagcgatccgcaacccagaagcaatggaagatgctaatgtaactgcaggggttaaagtcacaggaattgctgatgcccccgaagtcaaaatcttctcaaccccgtcaatgtcacaggatcaggcattatcctacattttaactggacgaggattagatggcggtagcgatgcagattcaagcaattccgttgctgccgccttaattggaatgagtttatcaaaaagcagtaaaaccgttggcaccgtcggcagtgcctttggtatcaacgatctcaatgtcactaccgcagggattggcgataacacaaaagtcgtcgtcagtggtagtttaacaccgaaattcaaagtaaaatatggcgtaggactttttgcccctcttaccgaattaaccttacgctaccgccttgccccaagcctctatttgcaatgggtgtcaagtatcaatcaagcggtagatttgatgtatcggtatgaatttgattagttttttaatggaaattagcacgccaaataaagattgacttttatatagaaaatttataccatcaaaggcgataggattaatatcctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaacaaaaaggcacggtaagtgcctttttgtgtttataaaggaatatcaatatgaaacaagaacttcaactcaaattgtgcagaattaatcctgaatatacaaaatttttacactctattgatactcgtatttctcccgaaaaagaattggataaaaataaaagacgtatttttgttggcgttgtattaacaattaaccatatttcttattttgctccattatcatcagcccccaatactaaaaataataagaaaccatttgataagcgttttgttattaaaatcacaacgggtttcgataataaaaaaactattgcgggtattaaactaaacaatatgtttcctgttttagatactgttattgaagacatagatcttactaaagaatttgaagaagagcataaatatgcttcattgttgatgaaagaaatgctttttatcaataacccaataaatcaaagaaaaataaaggagaaagcaactaaagtttattcaaaagcaattaataaaaaagataactttgaacaatattgttgtaattttaaattgcttgaagaatattatcagggttttgaaaaatctcagtaatttaattgaaatttcatcatttacgcacatataagtggacactcgtggaaaaacaacgtcaaaaacaattacaaaaatggctacgccaacagcaaaaaattgtaaaaaagtggctttatttaaatgtcttattcggctcattcagtgcaatgttattaatcgcacaaatgggtttactcgccacaatgttacatcagatgattgtcgagcatcgttcgccgacagaatttctgtcacaacttggattattactgacttgctttgcaggcagagcgatattgctttggttaagagagcggactggttttaaagctgggcaaatgttgcgtattcatttgcgtgagcaagtaatggctaagttgtctcacatcggtccaatgtcgatccaacaacgccctgcaggaagctgggcaacgttaatgttagaacaagtagaaaatatccataatttctacgctcgctacttgccacagcaatatctatccttaatcgtaccgcttgctattttggcggctgtttttccgttgaactgggcggctggcttaattctatttgctaccttgccgctgttgccgttgtttatggcgttagctggtattaaagctgccgaagctaatcaaagaaatatcggtattctctctcgtttgagtggacagtttttagatagcttaaaagggctagaaacgatccgcctgtttgggcaagccgacaaacagacagagcaaatttaccaacgtaccgaagaatttcgccaaagtacaatggacgtgctgaaaatggcatttctttcttctgcggtattagagttttttaccgccatttctattgcggtaatggcggtctattttggttttacctatttaggtgaactcaattttggtgcttacaatacttctgttaccctctttatcggctttttttgcttgatgttagcccctgaattttatcaaccattgcgtgaattaggggtttattatcacgataaagccgctgcaatcggggcagcggatagcctagagcattttttaagtgaaacggttttagctcaaaccaccgggcaaaaaaaagtgccaaaccaaccgcttgaaattcacgcccaagattgtgtaatcctctcgccacagggcaaagcattaacagaaccgctaaatttccaactacaggctcatcaacatattgccttagtggggcaaagtggggcaggaaaaagttcattgatgaatatgttgctaggtttcttatcttatcaaggtagcgtgaaaattaatggcgttgagctaagagaactcgatatggctcaatggcgtgcgactttggcgtgggtaggacaaaatccacagctaatgcgaggctcactacgagaaaatattctattaggtaatgaacacgccaacgaaaccgatttaacaaatgctcttgccttgtcaaaggctgatgaatttgtctatcgtttgggattagatcgagaaatccaagatggcaatatcgggctttcaggcggacaggctcaacgtattgccattgctcgagccttattacgccgatctcaactgctattacttgatgaacctaccgctagccttgatatgcaatcggaacaacaggtgctaagtgcattgaacaatctcagccgagagcaaaccacattgatgattacccatcgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgatgattacccatcgtattgaagatttaaaagaagctgatgaaatttgggtaatgaaacaagggcaaattatccaacgtggaaactttaccgagcttgccttacaaggttttttgcagaattattaggaaatcaataagctatgcgttcacttttcccttttcttgccctgtataaaactcattttgggcgtttaacattaggtattattttggcgatcaccagtctgactgcgagtatcggcttgctcagtttatcagggtggtttttagcggcgtctgctttagttggttcaagcctgctctttaatttcttttatccatcatcaggggtaagaggacttgctatcggtcgcactatttctcgttattttgaacgcctagtcacgcacgatgccacatttcgtgtactggctaatttacgcattgcggtatttagtaaactcattccccttagccctgcaggattaaatcgttatcgccacagtgagttgcttaaccgccttgttgcagatgttgatacccttgatacactctatctaaacctactttccccttttatcagtgccattatggttattctgtttatggggataggcttgtcttttgtttcgcctctattagcgtgggtaatttgtggcactttagttgcattattactgattttcccgacacttttttaccatttaggcagaaaattaggcaaaatcgcgatacaatccagagctacctaccgctcacagtttatcgagtggatccaacttaacggcgaatttttactatttggtgtattgtcaaaagccacagatagactaaaacagaccgaacagcaatggctcagggcacaaagccacgaaagccagttaggcggtttgtcaaatgccctcttaatgtttattaacggcattttagtcactgccgtgatttacttatcagcgaccgccattaatgtaccacaggcagacaaccccgaagcccttatcgccttagttgtcttttgcgtactggcttcccttgaaatcttaatgccgatcggaatggcattcttacatctaggacaagtgattgaagcggcagaacggatcagcgaaatcaccgcacagcaaccagcggttcaatttaatggcacggctcaatggaaacaaacagaggctaaccaaccgcttattagctttaatcaggtaagtttttcctattcaccagagcacgagcaagtactcaaccacatttcatttgagataaaaaaaggtgaacgcattgccatattaggtaaaacgggtagcggaaaatcaacaattttccaactactcacccgcaattacgatcccacaagcggcgagatcctcttaaatggttgcaatattaaagattaccctgaaaaaacattacgccaacaaattgccgtacttagccaacgcgtccacattttcagcaataccctgcgtgaaaacctacgctttggcaacccacaagccacagacgaagctttatctgaagcgctggcaaaagtcaatttaagctaccttctcgaagaacaaggtttagatttatggttaggcgaaggcgggcgcccactctctggtggcgaacaacgccgattaggattagcacgcctattactcagctctgccgatattctcttacttgatgaagcaacggaaggattagatcgagatacagagcaacagatactaaaacagattttatcccatactaaaggaaaaaccttgctgatgattacccatcgcctaaatgggttggaacaatttgatcgggtttatcggatagcttctgcgattctgaggtaaggatgttaaagttattttgtcctaggtcgatattttgcatggcatagaacaataaactagcgacaatgctactatttcttgtcgctattttaagcatatggaaaaacatcgttagtttttattatttttctaatgagtagctggcttcaaatttcagcctattaatcaatgtattatttgcaggcggaaattgtccttcttctaaatcttgttgagcaatccaaaatccctcttgcccttcccgaccaaaaggttcacctacccactcttccaccaaatagaaaaaaaactcaatcactttagttggatactcgaaactgaaatgttcatacggaaaagcacttaacacataaataccgatttcttcttccaattcgcgacgtagtgcttcctcaggtgtttcaccttgcgacaccttaccgccaggaaattctagcgactgagcaaaatcttgtccttctaaacgttgtgttaagtaaatttgcccaaattcattgcggataattccagctgaaacttgaataagaggtttagacataataattccttgtataaaaccaagcggtcagaactgtaaaataatttacttgtctgaccgcttatcaattatgaatatttcgctttgctaccgtgacaatgcttatatttcttacctgaaccacaagggcaaggctcgttgcgtccgatatgaagatcgctgaaatcctgctcttcaccttctgcgtggtagtgagatgactcttgttcagcgtgagcttgtcgttcacgttctgcttgttctacttcttcttggctacgcacttggatacggcttaatacgctgatcacgtttgattttaagtggtcgagcatatcggtaaacattgcaaaggactcttttttatactcttgcttcggatctttttgggcataaccgcgtaagtgaatccctttgcgtaagtagtccattgcagataaatgctctttccaaagttcatcaaggttctgtagcatcacacctttttcaaaactacgcattatttctgctcccaccatcgtttccttcgcttgatactgctctttagcaatgttgatgatacgttcacgcaaggtttcttcgtgtaaatcatcttctgcttcaagccattttacaatcggcagttccataccaaactcttgtttcaagcggttttctaatgctggaacgtcccacatttcttcgatcgattgtggtggaatatactggtcaatgaccgcattaaacacatcttcacgcacagtgttgatcatcactgaaatatcgtccgtttcaagtaagtagttacgttgctcgtaaattgctttacgttgttcgtttgcgacatcatcgtattgtagaagctgtttacgtccgtcaaagttgtatgcttctacttttgcttgagctgaagcaatcactttagtcagcaatttcgattccattgcttcgccttcttcggtaaaggctttacgcatcatattgagcttaccttcattgaggtaaattctcattaaggcatcatctaatgacaggtagaaacgtgatgaaccagggtcaccttgacggcctgaacgaccacgcaactggttgtcgatacggcgagattcgtggcgttctgtaccaataatgtgtaaaccacccgcttgcattacaatgtcgtgacgttcttgccatttagctttgatctcgtcaatttgctcttgggttgggttttctaattttgcaatttcagctttccagttaccgccaagcacaatatccgtaccacgaccagccatattcgtggcaatagtaacagcccctgggtaacctgcatcagcaacgatttccgcttcttgtgcgtggaatttggcattcaatactttatgcggaataccagcttgttttagtgcttctgacagtgcttctgatttttcaatcgaaatcgtaccgactaatacaggctgattacgagccatacaatcctgaatatccttaatcaccgcttggaatttctctggttcgctcttaaacattaaatcggttttgtcgtcacggatcatcggacggttagttgggatcaccacggtatctaagccgtagatttgttggaactcaaaggcttcggtatccgctgttcccgtcataccagctaatttttcatacagacggaagtagttttgataagtgatagaggcaacagtttggttttcgccctgaatgcttaccccttcttttgcttcaatcgcttggtgtaaaccatctgaccaacgacgaccagccattgttcgaccagtatgttcgtcaatgatcacgatctcgccatctttcacgatataatcaacattcacttcaaacagtttatgggcgcgtaatgctgcataaacgtggtgtaataagctaatgcgagctgggtgataaaggctttccccttcgtgcattaagcccatttccgtcaaaatattttcgactttcacttgaccacgctcggtcaagtgggcttgtttgcttttcagatcaagggtgaaatcgccgtcgcctgtgtactcttcggtatcttctttatcttgagcaattaaatgcggaatgactttatcaatcgcttgataaatttgtgtcgcatcttcggctgggcctgaaataatcaacggtgtacgcgcttcatcaattaaaatcgagtccacttcgtccactagagcatagtgtaatggacgttggaagcgctcttctttcgaatgagccaagttatcacgcagatagtcaaagccaagctcgctgttcgttgcataagtaatatccgctaaataagcttgacgtttaacatcggacggtagcccagggatattcaccgcaacggtcattcctaaaaattcaaataacgggcggttagtttccgcatcacgacgagccaagtaatcattcactgtcacaacgtgaacccctttacccgttaaagcatttaagtaacaaggtaaggttgcagttaaagttttaccttcacccgtacgcatctctgcaatgttacgttcggtcagcaccataccgccgattaactgtacatcaaaatgacgcatacctaacacacgcttactcgcttcgcgcacagtggcaaaggcttcgtgcaataagctatctaaagttgccccttccgctaaacgttgtttaaattcagcggtttttgcttgtaattgctcatcggttaatttttcaaattcagcttctaaacggttaatttgtgcgacacgcttgtttaaacggcgtaaagtacgatcattgctactaccaaaaatagcagtcattaattttgtaaacatatcaattttttccaaaaaaatataaggtaataagtattagtaacgagtttacgctccccctgcttgcggggggagctgccgaaggctgagggggggattttgcgactaacttgcaactttagtttcctcttttgccttcggcaccttccccccgtaaacagaggaaggaagatagaagaattacgctgttggtccagccctaatcggcggatttgatacttgatacaagcggtatgattttgcaaaaaactcgcaaaaaaccacagcttgtttagttggaataacgagaggttgttgttctaaatgtagtaaatgtgccgcctctaactcaactttttgaattgaagaaaaatcacttaagcgtaatacaagttgatttgtaggcaatgtttcactttcattcgctaacggctgagccgtaggtaacgcaaaaatcgcaacgatccctaataggaattgcgaaatcaatgctggcttatgaaagtgacgtaaaaaattcatttagcactcaataaaaaaataatgttgattatacgacaatttttgtagaataggcagaatataagggcaatctcaccaaaaacaagttaaagcacagcaggaaagatgaaaaattcaacaataaaaaatatcaatgagattttgcagaactctagcttgacgaaaattgtccaacgagccaatgaactcaatgaattaaatcgaaaaattcagcaattactgcccgaacaataccgtggactttaccgaattttgaatttatccgataatttacttagatttgaagtacaaaatggcactgttcgtcaagggctattgttgcagcaaaccgttctattacacttaattcaggcagattttcctgaagtaaccgccttagactttaaggtaaatcctaattttaaatctgcttaacctaagaggatatgactatgaaaaaaattgcatttgccagtattatcgcaatgttaaatgcctgttcgatatggcctcaaaaaactgtttctggcacttatcaaggcacactaccttgtgcagattgcgaaaaaatcgaagcacaattaattttaaatagtgataaaacctatcaatacaacacggtttattttaagaataaagagcaatatccttttacagaaaaagggagttatgtttgggatcaggataaagatgatgtgcttcatttaagtaatgattttaaatttaaagtccgtgaaaactttgttgagttttgtgatgagaaggggaatgtgttaaaaagttggtataactataaattaaataaagtttctcactaacatacaaaactcagaatatgtttgtctactatgccacttattatgctacctatttatcaattttattaatagttttacataataatcggcattataaaactattatattcatctgatgctctgcaaattgcggataaagttgtgctaaagatttcccactcggcaaaaccaattcaggactgatttcatataacggtacaatcacaaactctcggttgtgcatatcgtagtgaggaacagttagacgttcgctttgaatttgttcattgccatagagcaaaatatcaagatcgagagtgcgttctccccaacgacgtaaacgaactcgcccttgttcattctcaatactttgcaatttatcaagtagctcgatagcggtgagatccgtgtcgaattttaccacggcattcacatagtcaggttgatcctgtgggccgagtggtttactgccgtaaaaagagctaacttttagattttttgcaaaggtttgcaacgaaacaaccgcttgcttaagttgagcaagcggatcttctaagttagagccaagagccacatacacggttgtcactattcttccctttttacgattttctttttacggttgaatttacggcgtgggtgacgttttttctttgattcttcgtcacggaaagtcggtagctgtttgactgtttttaacatttccgcacgctgtgcttcattgctaaattggtattcgtgccaccacgcacttaattcaactaaatcaccaccttcaatttcagctcgcatcacgagtaaatcaaagcctgcacggaatttaatatgttcgagagtttgctgtggacgttttcccgtacgttttggaaattggaactgtaatgaccaaatatcacgaataacggtcgtataacgacgatgtaatgcgaccgctttgacactctctgccaaaatttcattggcagccaacatcattgcatcgtggctgtttaaaccaccttggtttttcaattcgtcaattttctcgcgtagcggataccaaagtagcgctgcaaataaaaaggcaggattaactcgtaaatcgtcacgaatacgttcatcagtggaattgagagccttgctgatcattctttcgctgttgctgtcgccatattcggtaaaaaatgggcttaatacagggaaaagttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaataaaccatatttgcgtaataactcgtaggttttgtgaccgtaacctgattgcagtaatttcaacgactcatcaaataggcgtgcggcaggaatatttttcagtaatactgccattttgcgaataggttcatcactcgctttatctaggaacatatccagttttgccataaagcgaattgcacgcaacattcgtacaggatcttcttgataacgagtaacaggatcgccgatcaaggcgagttttcctgctttcagatcgtctatgccattgaaaaaatcgtagatcaaattatggctaacatcatagtaaaaggcattaacgctaaaatcacgacgctctgcatcttcccgaagtgtgccataaacattatctcgcaacagcattccagcttcgctggttttcgacattttttccgtcgcattgctgtgatgatcggctcggaatgtggcaacttcgtaaatctcacgcccaaagacgatatgggctaagcggaagcgtcgtccgattaagcgacactggcgaccaaagattttttgaatttcttctgggcgagcattggtcgcaatatcaaaatctttggctttttgacctagtaataaatctcgaatacaaccgccaaccatataggcttcatagccatttttttgcagtttattgataatggcaatggcgttacttggaaaatcttttggagaaataccgtaatgccctgcaggttgggtaaattttttatgcagaatatgggacggtacggcttgttgcttatggttcgatttcttcttagatgtgtgtcggtgcggttcagtcaattctcgggctgaacgcattgggcgagcaactttcttcgcttgatctgtttcaacaagcggtgagtttgtatccttttttttacgactaaaaaaagatttgatgtaatttaaaatagatcacctcaattatataaaattgtagggtgggtcttgacccaccgtttcaatttatatgcggaagtggtgggttaaaacccaccctacttaattaaccgcccatctgtttttcacgcagttctgcaagggttttgcaatctacgcaaagttctgccgttgggcgagcttctaaacgttttaagccgatttcaataccacaagtatcgcagtaaccgtagtcaccttcatctaacttgattaaggtttgctcaatacgtttaagcaatttacgttcacggtcacggttgcgtaattcaaggctaaattcttcttcttgcgttgcacggtcagcaggatcagcgaagttagtcacttcatcttgcatttgacttttggtacgttccgcttcctccataatttgtgcgtgccacgcttttaaaattttgcggaaatgctcaatttgagcttcattcatatactcttcgtctttacctaattggtaaggcgacacgcccgcaaggactaataaacttaaagaagtggattttgccactgtcatatttcactcctgtttttggaatttttcttccctaattttaccgctctatttagggtgttttgaaagcgcgtataaataacagaactctctgcatttggcaaattaaatttgcaaaattgagggggaaaacattcagattgtactagttttcctatatagctattgcaatggcaagtatataagaaggttatgatttttcaaaaacaatagagtctaagtttaatttaatattcctctccgtttcgcctcaatcttttctaacaactgcacaatcgtctgattcgcaaaaatctcttgtgtggttttactcaattttctgcgccagtttggatattcggtgcttgttccagggatatttaccggctctagcatatttagccagtcttccggttgtgagccgaatagtacgctgttggtatctgccacatagctttgtagctggtggttaaaggtctgagtaacgcctgcactgtctgcttctaacggttgtaccgcttcaacggcacggcggatcgcttctttgtttgtatggcgagtgtttttcagaatgttaagcactttctcattcgggtaaacgccatatttttgccctaactcgaaatcatagcctttccagtagccttgtaccgttggtaaatcgtgagtacttagggtggtcattgcttgatacggatagttagctaatggtttgcttccttgatggtcgtactcaaaatagaaaatgttgtaggctaaaatacctttttcctctaaggcttctaacattcctttcggtacagttcccaaggcttcggcaatgattaaacattggtggcgttggctttcaagggctaagattgaaagtaaatcttccaacggatatttcacataagcgccgtttttcgccgagtcgcctttcgacacccaccataaacgggcaaagccgagaatgtggtcgatacgcaatgccccacaatctttcatattggcacgcagtaggtcgataaacggctgataaccacgctcttgcaacacttcagggtgcattggcgataagccccagttttgcccttgcggtgccataatatccggtggtgcacccacagatgcccctaacacgaacagatctttatccgcccacgtttccgccccgttatctgccacgccaacggctaagtcacggtagaaaccgatcggcataccgagctgttttgccagttcgttacaggctttgagctgttgttgtgccacaaattgcaaccacatatagaaacggactaaatcgctctgttcttgttggaattgttgtaccgcagcggtgtgataatcttgatattttgcgtcccagcagttccagccccattgttcgctgaattgagaagagagccattgatgtagagcatcaaacgtgccttgcactttcaaggcttcgccgttttcagtaataaattgctcaaaagcggtttgatcttgctgtttaaattgctcatatgccaagcgtaagccttgcaatttcagccacatcacttgtgaataatcgacataatctttttggcgagcttcgtttaattgacgttgaatatccgctgaattaaaccaagtttgagcttcacggctttgttggaaagcgtcaatcgccccaacgttgatataagcaatgttttgccataaacgagaagatgggctgtaagggcttgccccttcaggattggctgggaataacgaatgaattggatttaacccaacaaaatcaccgcctttttctgctaattttgttaaaaattccgctaaatcaccaaagtcgccgatcccccagttttgttctgaacgtagggtgtagagctgtaaaatcgcgccccatagttttttatgctctgccagttcttgcggttggtaagcacgttcaggggtaacgataatgcgacattctgcggttgtgccgtttagacttaattgatgataaccaaggggtaaatcacgaggcaggtcaatgctattgcgtttgcattttcccgttaaaatctcaccgctttcaagggtcaacgtccagtttgcgtgaacggtttgggttttatccgccacaaaaagcggaataaagacttgctcgccttgtttgacgactttaacaagcggtaggattttgcgactttttggcgaaccgagcaattttgccactttgccataaacggacggttgggcataaacacggcgaccgtgttcatccacgaagtaacgatttaaaaatgggtggttttgtttcattgttattgtttcccgaatagtattattttttgtagggacacactgcgtgtgtccatttgattatttttcgtttgaatagcggacacacgcagtgtgtccctacaattttattttatcctttcaccccacctgccgttaatccgccgactaaccagcgttgtgcgatgataaagactaaggtaattggaatggcggataaaattgctgccgctgcgaaatctccccataggtagttttgtgggtgtagatattgttgcattccgaccgcaagggtgtagttttccacatcacgcaataagagagaggcaacaggcacttcgataattgcagagataaaggcaagaatgaaaactaccgctaaaattggcacagataatggtaataaaatcaaacggaatgtctgccacggggttgcaccgtcaagtgctgcagcttcttcgagcgatttatcaatggtttcaaaatagcctttgatcgtccaaacatgcattgcgataccgccaaggtaagcgaagattacaccaccgtgagtatttaagcccaagaacggcacataagttcctaagcggtcgaataacgcatataacgccacaagtgaaagtaccgctgggaacatttggaaaatcaacatactttgtaacagcattgatttacctgtaaagcgtaagcgtgcaaaagcgtaagctgccgtagtagaaagtgctagggtaataattgccgtgacacctgcgactttaaccgagttccataaccaaagtagcacagggaatggcggtggggtaacagtgccgtccgcattggtgacgctaaaaccgagtgccagtttccagtgttcaagggaaatttggcttgggataatttcccctaatgccaagttacctgggcgaagtgagatccctaaaatcatcagtaaagggaacataatcaatgcacagaacacaataagaaagaaatgtgttgcaaataagcgtgctttcattgatttaggttgaacgatagccattttatcccccttaatcctgttgtaatttagtcaaacgaatttggaacaacgctaatccgctgacgagtaagaagatgattactgcgattgccgccgctaaaccgaagtcttgcgtaccgctaccttcaaaggcgatacggtaggtatagctgactaacaagtcggtatgtcctgctggtgtgctggttccgatcattgacggccgaccttgggttaataattggattaacacgaagttattgaagttgaaggcaaaggtcgcaatcatcaatggcattaacggcttaattaacaacggcattgtgattttggtgaagttttgccataccgatgcaccatcaatcgccgaggcttcgtataaatcgtgcggaattgctttaagtaagcccatacaaacgatcatcatatatggataacctaaccaagtgttcacaattaaaatcatcactttagctaagaacggatcgttaaaccattccggacgaatgccgaataggttattcaaaatgacgttaatttcaccgaaactttggttaaacaagcctttaaatacaaggatagagataaagcccggtaccgcataaggtaaaattaacaataaacgataaacggctttaccttttaacgcttcccattgcaccagcgatgcaaaaatcataccgagtaaagtggtaaatacgacggttaagaatgcaaaggtaactgtccaaataaagatttgaataaagggtttttgtacaccttcgtccgttaagattttcacgaagttttgccagccaattgctactgtataacctggttcaacacgtttacctgtaaagttaccttgctcatcaatttgctcaaagaaaccgacatcatcattgggtttataacgttcattggtttcgtggttggttaaaatttggctctctgcatcaaagctaaagcggtagctttgttgagaaaattgacgaagtgaactcatcgtgagcatttcttcgcttggtaaaatcgcattcaccgtttgaagttgttggcgattttgggtaatggttttaagtggtgcaactttgctttctggcaatgttgccacttcttctaatttgatttccccttttaaatcggctagtgcaagcggttcagaaaggtaagttttttgcacatttttattttcaagggcaagctgatattgattatccgctgtttcaagtagtttgaaatcataacgttcgcccgaaaaatagcgttggctttgcaattgattaactacacgttcaaaggcgagctggtttgaaccgctgtaattagtaaaagcgataacaacagtacagacaagtggaaagactacaaatatgccgattgcggatatgcctgggaacagataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccagcgataagcccgttctgagctaaacacaaaaatacctgaagccactacgactaaggttagtaatgcaaataaaatttcaccttgcagataaattgtaaaaaccaagtaaaaagcaagtaggtaaagtaatccgacaaaagctcttttgccccaaagttgagcaggcgaaatcgaggaatgagttgaagttagcattttaattttccttgtttttgtgctgctaagaggaaattgcaaaaaaagagaagaatgtgatcgcttgatactcgtagggacacactgcgtgtgtccgccagtctgcttgtgtccgtctaatttggattatttaacggacacacgcagtgtgtctctacattttttatttattaaaaattactctttttcaatcttcgcttgtgcttcatctaatgcggctttaacagattggcgaccattgattgcactgtcaatcgctgctttttctgaataccagaaacggctcatttgaggaatatttggcataatctcaccattttctgcatttgccattgttgccgcaatacgcggatctgccgctaatttcgcttggtagctcttaagtgctacagcacctaacggagtatctttattcacggtttctaaaccagcatcagttaataagtggttttctaagaactctttcgctaagtcttggttcggacttgacgcatttactgctgcacttaatacgccaacgaatggttttcctgctttaccgtttaaggttggtagtacggctacgccatagttaataccgcttttctcgatatttgcccacgcccacggaccgttaatcgtcattgctgtttcgcctttattgaaagaagcttcagccacagagtagtcagtgtctgcgttaatcactttgtttttcacaagatcaacgacaaattgtaagcctttttgtgcagcttcattatttacaccgatgtcttttgcatcatagccgtttgcggtcactttaaacgcataagccccttgagaagagatgattggccaagtgaaatacggttctgctaagttccacataatcgcatttttgcctttcgctttgagatctttatctaatttctcaacttcttcccaagtttttggcggatttggtactaaatctttattgtaaatcaatgagagcgactcaacggcaatcgggtaggcgatctgtttaccattatattttgtagcttcccaaccgatatcagataattttgctttgaattctgcacttgggtgaacttctgctaataagcctgattgagcatagccaccaaaacggtcgtgagcaaagatcacaatatcagggccatcaccagttgccgcaacctgtgggaataattcttctaatttgcttgggtgctcaacaaccacttttacgccagtttctgcttcaaattttttacccacttctgccaagccgttataacctttatcggcattgatccagatgttgagttgtccttcaactaattttgcatttacaccttgtgcgatacataatcctgctaataccgctaatgctgctttggttaattttttcattgtttttccctcagtttagtgaaatgaaattttgacggtcgaatagtggatgatttcgtctcatacttcatcatacccccttatcctccccccttatccttttagtgatctgtatcacatttttgattgtttttaaaataagtgtgaaagagatcacaaaaaaagcgtatgaatttgtgatctaagtcacaaaaaatctgcttttctgcgaaaaaattttttacaaggtagtgaaaaattttttcacaaagtatgatttcaagacaagaggaaataagtaatcttggcacccgtcaaaaagtagtaaccctaaggcaaaggataagacaatggcagatgtaaaaattattggtgtaaataaatcatacggcgatgtgcatatctcacgcaatattaaccttgatattaaagaaggggaatttgtcgtatttgtaggcccatctggctgtggtaaatccaccctattgcgtatgattgcaggcttggaagatattacatcaggcgatctctttattggtgatacccgaatgaatgatgtgccacctgctcaacgtaatatcggaatggttttccagtcttacgcactttatccacatctgaatgtggctgaaaatatgtccttcggcttaaaactggcaggtaaagcgaaagcagaaattgagcaacgagtaaatcaagtcgcagaaattctccaacttgctcacttactacaacgtaaaccgaaggaactctccggcggtcagcgtcagcgtgttgcgattggtcgtacgcttgtttctcaacctgaagtgtttttattagacgaaccgctctcaaaccttgatgcagcccttcgtgtacaaatgcgtgtggaaatttccaaactgcataaaaaattaggtagaacaatgatttatgtcacccacgaccaagtggaagcaatgacccttgccgataaaatcgtggtgttacaagcgctcggaaacaatacacaaattaccactaacgttgctcaagttggtaaaccattagaactttatcactacccagccaaccgctttgttgctggctttatcggttcaccaaaaatgaacttcttacctgtaaaagtgattgatgtaagagaaggtggggtaaaaattgaattacctgactccacccatctcaacttctggatcccagtagataacacaggtgtgaatatcggcgacaatatctctttaggtattcgtccagagcatttactaccttgtgatcagagtgaagtgtgcattaaaggaacagtaaaagtcgtggagcaacttggaaacgaaacccaaatttaccttgaaatgccaccaatcaaacaaagccttgtttatcgccaaaacgacatcgtattagttgaagaaggtgatgaaatgtcaattggtatcaacccaaaccgttgccacttatttaaagaagatggcacagcttgcagacggttgtttaaagagttgggtgtttgagattatctggatagtaaatcaaattaataggttattttaaaaataggtaggcataattgtatatgtgaacaatcatcctaattttttaaggagactgattttatattgataaggaaagctttgtgatatcttaggtgttatactagtactatatgtaagaatttttatttggattttatgtactggaagatatggtgaatttaatgcagccccccttaagcctatacatccatatcccttggtgtgtacaaaaatgcccctattgtgatttcaattcccacgcacaaaagggcattattcctgagcaagaatatattcagcatttgctcaatgatcttgagcaagatctcataagctataaaacagcaatcgctgatcgcaagatccactcaatttttattggtggcggtacgcctagtcttttttccgctgaaggtattcattatttacttgcagaaattcgcaagcggatagatttttctcacgaatgcgaaattaccctagaggctaatccggggactgctgaggcagaacgttttatcgggtatgtacaaggtggcgtgaaccgtatttcaatgggtgttcaaagttttgaaccagagaaattattgaaattagggcgtattcacgatagcaatgaagcgaagcaagcggttagatttgctcaaaatgcaacaaaagtaggcttgagaagtttcaacatagatttaatgcacgggttgccaaatcaatctgttgctcaggctcttgatgatttacggcaaggtattgcgttaaatccaccacatctttcgtggtatcaattgacgattgagccgaatacgatgttttactatcgacagcccacattacctgacgatgatgagctttgggatatttttgaacaagggcatcagcttttaactgacgcaggctatgaacagtatgaaacctcggcgtatgcgaaaaaggggtatcaatgtcagcataatttgaattattggcgatttggtgattacttagcgattggttgtggggctcacgggaaaataagttatccaacaggggaaatttaccgctttagcaaaacgaagcaccccaaaggctatatgcgaggagagtatcgttatcatcaagagatgattgaaaatgatgatcgcccttttgaattttttatgaaccgttttcgcttacttgaagcaaccccaaaaacagaatttgaggcatatacggggctagatcggacgcaggttcaagccacaatggactgggcattgagcagaaattttatcacagaaaacaatacatcttggcagattacacagcacggcaaattatttttaaatgaattgttggaaggttttttaaaggaatagaatgcaaaatccctcttatttaaaataagagggatctttatcaaaaaatatttgtttctaaatgaatatgtcctttttcaacaataatatgttttccaaatttttttacaagggattcttttgttctgcgttcatctaatgtataaacagggtggctatttaagatatttgtaagactatcagcaattattggtaaaaacacctgaagttcattttgatatttttcaggggtagcgttccaattttttaaacgaacattttttagaaatagtgcacctttttccatatcatagaaaggaagagtatccatatttatattaagtttaacttgatattctttaccctttatctgtaatagactgtcgatgatgcctgaaatatcaacaaccttttcatctgtttgtcccacctttgtatataaatcagataatttatagtctagttgaaatagtcctggtacacctaaactatcttgcaaaggcactttttctgctaaacgcgtagccaaatattgattgatttcttgctctgaaatactcaacggactcgcttgagtagtcataggaaaaattatcaacaagagtaagctcagtttatgtaaaagtttcataaaatctcctttggaattggtttaaagtgttaaaacagagtagaatgcgcatcttttgaaactgaaagtttataatagtttttaatacaaagggataaatatgaaaaaaatattcgtgattgcctctattttaatgctcgcaggttgtacttttggtggaagtgtaaatgctggtggtggttctaatggggtcggtattggcttaggaatcggtacgggtatccgtttctaagaactttttatggctttgctgtcaaatagacacttttctataaatatttaaagggaaatcaatgaaaaatttgttaaaaaaatcgttgctaggtttagcatttctctcattaaatggctttgcttttgctgatgctcaagctgtcgcagagttacaacaacgtttagataaagcaatgcaatacagtgcggattttgagcagactgtccgttcaagcaaaggaaaggaaattcaaaaagggcaaggtaagtttcaagtcaaacgcccgaacttatttcgtatggacacccaaagtcctcaagaaaatttaattgtatctgatggcaaaactttgtggttttacgatccttttgtatctcaggtaacggcaaattgggttaaagatgctgtgagcaacacaccatttgtacttttaacaagcaatgataaaagccattgggatcaatatgatgtcacacaaaatgtagataattttgtattaaaaccaaaatcgaaaaaaagtgcgatcaaacaatttgatattcgtattgatgcaactggcttagtcaaaggttttagcactattgaacgtgacgggcaaagtaatctctatgtattacgcaacatttcaacggctcatttatctgaaagtctgtttagttttagtatgccaaaaggggctgaattagacgatcaacgtggtaaaaaataagcataacaaagagtaaagcggtaagatttgcagatcttaccgtactattgtactaacaggataagtaagtatgagaaccctttatcaacaacgtgatccaaaagaatggcaacaatttgttgaccttttaaaacaagcggtagcagaagataaaacagatgcattattgtcgatgttattgacaacagacgaacgaacttcgttgggattgcgagtgcaaattgtacgcgcattgctcgaaaatcaaatttctcagcgtgaaatccaacagcaattgaatactagtgcggcgactattacacggggttcaaatatgttaaaaactgttgagccagatattttaaagtggatagatacaaaactgaatggcaccaaaacctaagcaaaaatccttgctacaatctattttccgcttttttattcccaaacagatgctatctttaaaaagttggctttggtttggcgttagtcgtattggtgtggcagtcacaactttctatgtttctttaacattgatattttcagtaattcccgtgcctttttcagcttatatgctacagaaaaaagtggaacacctaatacaaggggacttatataaaattcaatatcagtgggttagtcttgatcgtatttcgtggcaaatgcaaatgtcggttattgctggggaagatcaaaaatttccaattcattttgggattgattttgatgcgattgaagcagcaattaagcgaaatagtaaatctcaaaagaaagctcgcggtgcttccactatttctcagcaaacggtaaagaacctttacttatggcacggaacaagttggctaagaaaagggatcgaagtgcctttgacctttttggtggaattgctttgggataaacagcgagtgttagaagtctatctcaatattgctgaatttggcgatggcatctttggtgtagaagcggcagctaaacattattttaagaaatcagcaagccagcttagtttacacgaggcttccttattagcagcctctttgccaaatccgatgatttatcgggttaaaatgccaagccaaacaatgcgagctcggcaacagtggattattcgacaggtcaataatcttggcggaataaattatttagaaaaattgtagctattagccctgacactcagggctattttggggggtaattccaagggggtaatagactatctcatacaattaaaaaacattttacaagcggtagattaatcgcaaatttttgacagattttattttttattacagaggttcactatgtctaaatttcaaattcatactatcgacactgcacctgaagcagcaaaagaagcattacaagcggttaaaaataataacggcttcattcctaacctaatcggcgtattagcaaatgcacctaccgcattagaaacttatcgcaccgtcggggcaattaaccaacgcaccagcttaacgccaacagagagagaagttgtacaaattaccgcagcggtcgcaaatggttgtggtttctgcgtagcagggcataccgcaatttccattaaacagatcaaaatgcctgacgaattactgcaagcattacgcaaagctacgccaattcaagataacaaattagatacccttgcacgctttacactcgctgttatcaacaccaaaggcaaagttggcgaaacgctacttaatgaattttttgctgtaggttacacccaacaaaacgccctagatgtggtacttggtgttagtctagctagtttgtgtaattatgcaaacaacctcgcagacacaccaattaaccctgagttacagccttacgcataatgaatgctaaaaaattattaattctctgttgtgagcctcgtttatatagttgtcaaagacttaaacaagcggcagaacagaatggctaccaactggatattctcgatccaaaccgcttcttgctacaactgcagcaagagcggttcgagctttattatcaaactggggaaagctacgacaaaactcgagcaaaacccgaaaaaatcggggaatatgcaggtatcttgcctcgatttggtacaactagcacagaaataggctgtaatgtattacggcattttgaacaaaaacagacacccattttaaattcatcttcagcttttgcactcgctcgtgacaaatggcaaagcctacagcgacttgccgcctgtggcattccagtacctgatacgctattaatgggagagctttacagcgttgctgaaggtttaagtcaatcaggcttgccagcggttattaaaacactgtcaggctctcaaggcgtaggcgtaatgttggcagaaagctatagcagtgccttgagtttacttgaaacattaaaaagtgccaaagtaccaagtctcttacaaacctttattgcggagtccaaaggacaagatattcgagcctttgtgattggcgatcaagttgttgcaacaatggaacgcactggtgcaagcggtgagtttagagccaatattcacagaggtggcaccgcccaagccattcaactgtctgatgcagaacaaaaaatcacagttcaagcagcaaaagccatcggcttagatgtggcaggtgtcgatcttattcgttctcaacaaggcattatggtgttagaagtcaatgcaagccctgggcttgaaatgattgaacaggtgactaaagtagatgttgcaggtttaatgatccaatatttattgagataatttagttaatagcctataagcggcgagaactgtaataaattgtacaaatctcaccgcttgtcttttccattctgctctgattaaggtacaataacgcctatttttatgtttaaataatatcgcctatgcaacacgaattagcacaaacgatcccagaactgattttatggacaaaagagcgagaattttcgctttccctttcttccgaccgcttggcatttttattggcgatagccctgtataataacgaacgcactgacggtgaattacttgaaagcgatttacaagatattttccgtcatgtttcaaatgcctttgagcagtctgaagcaacacaaacacagcgcgcgaataatgcgatcaacgatcttgtcaaacaacgttttttaaaccgtttttcgagcgaatttaccgaaggtttggcaatttatcgcttaacaccacttggtgttggcgtatcagagtattacattcgccaacgtgaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcgccaacgtgaattttcgactttacgtctatcgatccaactttctattgttgccgatgaaattcagcgcgcctctaatgcagcagaagaaggtggtgatgaacgtttctggcgtaatcaagtgtttgccccattaaaattctctgtagcagaaatttttgacagtatcgatctttcccagcgtatgatggacgaaaatcagcagcagatccgtgagcgtattgctgcactgttaagccaaaattggcacgaagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggcacgaagccattgcgacttgtcagcagttgttagacgaaacttcggggaatttgcgtgagctacaagatgtattaaatgcgtcaggggataagttgcaatcccaattattgcgtattcaaagttgcttgattgggcgtgatgatttggattttgtcgatcagctgattgtgaacttgcagaataaacttgaccgcattatcagttggggacaacaggcgatcgatctctggatcggctatgaccgccacgtccataaatttatccgtacggcaattgatatggataaaaatcgtgtctttgggcaacgtttacgccagtctattcaagattattttgaaagcccgtggcaactttatattgccaaagcagagcctttgatggatctgcgtgatgatgaaaccgaattaaatgaagcggaagccgtaggcgagctaccgactgagctagaatatgagtccctcacccaagtgcaggagcagattattgcagcaatgcaagaatatcttgtcccattccgtgaacaaggcaaaccgattgatctcggtgcgattttgcgtgaacagttggcaatgtatccgctttctcgccattttgatgtagcaagaattatcgtcgatcaagccgttaaactcggtatggcaagccaagacagccaagcgatttacccagaatggcagtcgattaatgataaaggtgcagaagtacaggcgaatgtgattgaccaatacaataaataacaagcggtcagttttaattaaagttttacaaaaatagagaacgacaatgacaaacacccaagaacttatttcaaccaaattggctgaagcgattgctaacccgatttttccgcaacttgacagtcaattaagagcagggcgacatattagtttagaagcccttgatgaacacgcttttttgatggattaccaaagcgagcttgaacagttttaccgccgttatcacgtcgaacttattcgtgcaccagaaggctttttctatcttcgacctaaagcaacaactttgattgctcgttcggcgatgtctgaaatggaaatgttggtaggaaaagtgttgtgttatctctatctcagtccagaacgccttgcacagcaagggattttccactatgacgaagtgtacgatgagttgcttaatttggcggacgaaaccaagttgcttaaagcaatcaatccacgttcaacaggatcagatttagacaaagcgaagctggctgagaaagtaggtggggcattacgccgtttaggtcgtttaggagtgattactcgtgttggcgatcaaaacagcaaaaaatttgtgatttcagagtcagtgttccgttttggggctgatgtgagaacaggggacgatcctcgtgaagctcaacttcgtttaatccgtgatggtgaggcgacaaagcctacgattgcgaaagagcaagcggtcagttttgacgaagaatttgcaaatgaagaaatagatgatggtgaagaatagtgaggatatattaattgtaatggaacatgagaaagtagaagaaccctcaatacaatacaacttatttaaagaagcatttccttcatattctgaatttacatttattgacttgtttgcaggaattggtgggtttaggcttgctatggagaagctaggtggttattgtgttttttctagtgaaattgatgaaaatgcacaaaaaacatacgcaactaattttggtgaaaaaccatacggcgatattactttagaagaaacgaaacgccttataccaacaacctttgacattctatgtgcaggatttccttgccaagctttttctattgcgggaaaaagagggggatttgaagatacaagaggaacattattttttgaagtagctgaaattattcgcagacatcagcctaaagcattttttcttgaaaatgtaaagggattgagtagccacgataaaggaagaacactaagcacaattttaaatgtgttacgagaagatctaaattattttgtaccagatcctaaaatacttaatgcaaaagattttggtgtaccacagaatcgagaaagaatttttattgttgggtttagacaagaccttgcgataaactctttttattatcctgcaccattaaataggaaagtttgttttaatgatgtgaaagaaaaaaatgttgtaccaacgaaatattatttatcaacacaatatattgaaactttaagaaagcacaaagctcgccaccaagataaaggaaatggttttgggtatgagattattcctgatgatggtattgcaaatgcgatcgttgttggtggtatggggcgtgagagaaatttggtaatagatcatcgaatcactgactttacaccaactacgaagataaaaggtaatgtgaatagggaaggtattagaaaaatgacacctagagaatgggctagattacaagggtttcctgatagttatattatccctgtcacagatacacaagcatacaagcaatttggaaattcagttgcaatacctgcagtgcaagcaacggcagagaaaattttggagcatttaaggctaggataaagataatatggcgaaaggaacaaaagtaaccgatatagtaaaattaatggttcataaatatccgataaatcaaaaatggaagccaaatgaattgatttctttttattggaatgtgtacacatcggaatttgaatctaacaattcagttaatggtggtgtatttgaacagttacttgtgctagctctgttaagagagaaaatatcacctgtatatgttcaagcagaattagcatttgttccgaatgttattttggatattgtgttatataaccgtaagacccctattactattagtgcaaaaacaactcttagagagcgttggaagcaagcagatttagaagctatggcgactaaatatgtgcatcgagaagcattgtgttatgttgttaccttatctgaaaatgaggtgcttgctcgacgtaaagaagaaaatagttacatggggataaatgattttgttctagctcatacagatgaatttaaccagttagttgaaaaattgaaacaaattcaaattacagaaagtgaaagcataaaaatcattcaaagtgatcataaattctatgataaagacagtgttgagaagctgtatcaaattgaaatttagtatttaggcaaatatatgacagaaaaaaacgacttatttgaacaaaacgtcacttctcaaaatatcatggttgcgacacatgtacaatcgtctatacctagtgtgagccgtggcaaattccgttccctaaccttaattaactggaacggtttttttgctcgaacctttgacttggacgaactagtaacgaccctttcgggcggtaacggggcgggtaaatcgaccacgatggctgggtttgtgacggcgttaattcctgatcttaccttgcttaacttccgtaataccaccgaagcaggttcgacttctagttctcgtgataaagggttgtacggtaaattgaaagcaggcgtttgttatgcggtgttggaaagcgaaaattcccgtgggcaacgtgtgattagtggtgtgcgtttacagcagatcgcagggcgtgataagaaagtcgatattcgttcgttttcattacaaaatatcaatgaaaatcaatcggttatctctgttttaactgagcaggttggtgagaaaaatgcacgagtgctggcgttaaatgatctaaaagagaaatttgatggcagtgaggtgcaatttaaacagtaccattcgattaccgattatcatagttttctctttgatcttggcgttattccaaaacgtttacgcacatcgggcgaccgtagcaagttctataagttgattgaggcttccctttacggcggtatttctagcgttattaccaaatctttgcgtgattatcttttgcctgaaaatactggcgttcgccaagcctttcaggatatggagtcggcattgcgtgaaaaccgtatgacccttgaggcaatcaaggttacgcagtcagatcgggatatgttcaaaaagctgattaccgagtccactaattatgtgtcggcagactatatgcgacacgccaacgaacgccgtggcaatgtgcaacaggcgattgaaaagcgtcaagagtggtatcagtctaaatctaaattaacccttgaacagcaacgtttggttgaatttagccgtgaaatgcaagatctggaacagggcgaaagtagtcttgaagccgagtacaatagtgcttccgatcatctcaatttagtgatgaatgcggttcgtcatcaagaaaaagtggaacgttatcaagatgatgttgcagagctaaatgaacgcctagaagaacaacaaatggcgttggaagaagtggcggaacgtcaagagatggctcaagctcgtgcaacagaagccgaagatcaagttgaagaattgcgttctcaaatggcggattatcaacaggcgttggacgcacagcaaactcgagcattgcaatatcagcaagcggtaaatgcgttagaaaaagcgaaacagatcagcggactggctaatttagatttacacaatgtcgaagattatcacgctgaatttgtggctcaagctgacgaaatcaccgacaaggtgtttgagcttgaacagcgtttatcagtgtccgatatggcgaaaagccagtttgataaagcctatgaacttgtttgcaaaattgcaggggaaactgaccgcttacaagcagacagcgttgcccgtgaattgctgagtgcgtatccaagccaaaaagcccacgcacaacaagcggtggctttgcgtcaaaaattgacagaattagaacagcgtttacatcaacaacataatgcagaacgtttgcttgctgagtttaatcaaaaagcacaagcagagttggaagatgcagaagatcttgaaagctattatgaagagcaacaagctcgtcttgaagatttggaagcggagctggctgaatttgttgaagtacgttcaacacaacgtcagcaacgtgagcaattaaatcaacaatatcaacaacttgcacaagctgcacctgcgtggcatacggcacaatcggcattagcccgcttgcaagagcagtgtggcgaaacctttgacagtagccaagcggttatgcagtttatgcaaaataccttaagccgtgagcgtgaagcaacccttgaacgtgatgagcttgctcgccgtgaacagctattagatgagcaaatttcacgcctaagccagcctgacggcgcggaagatattcgcttaaatcagctggcggaaaaatttggcggtgtgctgatttcagagttatatgaagatgtgtcgattgaagatgcaccttatttctccgcactctatggcgatgctcgccacgctattgtggtgcgtgatttggaagcagtcaaagcacagttacagcaacttgatgattgtcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctatttgatcgaaggtgatccgaatgcctttgacgataatgtctttaaatcggaagaactgggcgatggcgtggtggtgcaactgtctgaccgtcaatggcgttactctaagttctctgaatttgcggtctttggccgtgcttctcgtgagaaacagcttgagaaagtaaaagcagaacgtgatgaaacgacagaaaaacacgcagaacgtgcctttgacgtgcagaaatgccaacgtttacaccaacatttaagccagtttgttggtacgcatttagctttagctttccagcctgatcctgaagcggcaatgcaagagattgcacaaaaacgagctgaaattgagcgtgaactcaatcaagcaagcggtacggaacagcaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcaagcggtacggaacagcaattacgtcaccagctggaaaacagcaaagcacagttgcaactgttgaataaagtgttgccacaactcaatattcttgccgatgaaaccttacaagatcgcgtggaagagtgccgtgaacagctgttagaagcccaagaagatgaacaatttatccgtcaatttggtaatgcgttagcacaacttgagccgattgcggtggcgttaaagagcgatccgacccagtttgaacagctacaagcagattacaagcggtctgttgagcaacaaaaattgcaacagcagaaagtctttgcccttgctgatgtgatgaaccgacgtttgcatttcagctatcaagaaacagtaggggcggaaggttctgctcttaacgaacagcttcgccaacgtttagacaatgcacaacgtgagcgtgagcaggctcgtgaacagcttcgccaagcgacagcacaatttagcgaatataaccaagttttaacgtcgttacgcagtgcctttgatgcgaaaaatcagatgcttcaagagttgttgcaagagatggacgaatacggtatccgcaatgatgatggggcagaagagtgtgcgagaatacgccgtgatgaattgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcgtaaatcttatattgataagcaagtggcggttattcaagcggaaatggataatctcaacaaagcggtgcgtaaagcagagcgtgattaccatactcagcgtgaaattgtggtgcaggcgaaagtgagttggtgtttggtgttgaaactctctcgcaatagtgatgtagaaaaacgcttaaatcgccgtgagctggcttatcaatcggcggaagagttgcgttcggtttccgataaagcccttggtgcgttgcgaaccgcagtggcggataacgaatacttgcgtgatagcttgcgtgcgtcagaagatagccgtaagcctgaaaataaagtggcgttctttatttcggtttatcagcatttgcgtgagcgtattcgccaagacatcatcaaaacggacgatccgattgatgcgattgaacagatggaaatcgagctatctcgcttaactaatgaactgactagccgtgagaaaaaattggcgatcagctcagaaagtgtggcaaatatcttacgtaaaaccattcagcgtgaacaaaaccgtattttacaactaaaccaaggcttgcaaaatattgcgttcggtcaggtgaaaggggtgcgtttggtggtaaacattcgtgatacccacgcaattttactcaacgccttatcaaacgaccgtgagcaacatagcgatctgtttgagaaccaaaaactcagtttctcagaagcgttggcaatgctctacaaacgtgttaatccacatattgaactagggcaacgtacaccgcagaccattggcgaagagctattggactaccgtaattatctcgatctggaagttgaaaccttccgtggtgcagacggttggatgcgtgcggaaagtagtgcgttatcgacaggggaagcgattggtacaggtatgtcgatcttgttaatggtggtgcaaagttgggaagaagaatctcgccgtatgcgtgctaaggatattctgcctgctcgcttgctcttccttgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcagctcgtttagacgcaacctcgatcaataccttgtttgaactctgtgagcgtttggatatgcagttgcttatcgccgccccagaaaacatcagcccagaacgtggcacaacctacaagttagtgcgtaagatcacgaataaccaagagtatgtacacgttgttggattgaaggggtttgggaaggtttagtagacaaaagtagctttaagtcttggagagtaggggattaaagctactttatttagctatgtttttggcttcttacagttcaggttttcctctttcctagctaggataactagctgtcttctgtgatcaatttctcttttaatccccgctttctcgaagccatcgttaatcaccgcttgaatatccacttcacaagcgacttgatagagctgttttgcataatccgcttgtgggtattcccgattttcaaaacccaaacgccctttattatccgcttcgcaaaccaataaaaaatcaaaaaaacgttcgggtttacgccatacatcaagtttattaaacaatttcaccacggtttcagggcgtagctctgtgattttatggttatgggtgtgaaattccgttaccagtttagcgaatgctttagtgtgagctggcactttcaagcgatttgccagttgttttgttagggcaacgcctttctgttcgtgtccataatgatggggcagaatatcctttggggttaaggctttgccaagatcgtgacagagtgcggcaaataatacactttcaggatcatttgcccgagccgctaattttttcgcctgctccaaaaccatcaaggtatgaataccactatcaatttcagggtgatgtttttcaggttgtggaacgccaaagagtgcttccacttcaggaaatagcactttcaatgccccgacttctcgtagcacttggaaatagatgtgtggcgtgtcggtggcgaaggctttttgggtttccagccaaacacgctctgctgttaaatgagctaactcaccgcaagcggtcatttcttgcattaattttaccgtttcaggagcaatccgaaatccgagagaatggaagcgtgcggcaaagcgagccacacgcaacacccgtagcggatcttcggcaaaggcaggggaaacgtggcgaagcaggcgatgtttaagatcggcaatccccccgtaaaaatcgtggtagttgccgtcaagatcttgagcaatcgcattaatggtaagatctcggcggattaaatcttgttcaagagtaacctcaggggtaaagtcgcagataaaaccgttgtagccgttgccgtttttgcgttcggtacgggcaagggcgtattcttctttggttttagggtgtaaaaatacggggaaatcgttaccgacttgttgatagccttgagctaaaagctgttcgggcgttgccccaacaatcaaccaatcacgatctttgactgctaagccgagtagttgatcccgtactgcaccaccgacaaggtagatatttgtagtggatatcatcataggtatattaattcggatatattaggattggtgtattaagaagcattattctatgtattccaccacatcagagattgcttgaccggtcttcgctttaggttctaccgcacgataaccaaaggcgaccatcacactaagtttatagactttcggatcatacaaccctttttcgacaaaaagctgatccattttttccaatgggaaaccttcaatcgcggtgctatcaatgccaatcattgctgaagctgttagcatattggctaatgcaatatagctttggcgacaagcccagtgataaaacgccacaggatcttgggtcaagccaaaatccttttcactgaagttacgataaaaaccttgacgcatttttaacgcttcttcaggaatatggtgaacatctcgcataatatgttgtacatattcgccgtcagcaagcagagtttcaggctgacgaacaaggatcacaacaaaatggctacaatccatcaccttatcttttgccccccacgcattatcacgaataagctcacggatagcgtggttttcaatcactaaaaatcgccacggctcaaagccaaaagaacttggcgataaacgccctgtttccaaaataaattggaaatcttcatcactgatttttttcgttggatcgtattgcttgcaagcgtggcgataatggaaggcatcaagaatagcttgtttagaaatagacataatttgtttcccctcaatgaattgattaccatattatgatacgctttacttaaatttcaaaatatcaaggagtaaatatgtcaaaaacctttagtgaccaagccgattgttgtggtggtatttgtaaaccaagtagtacgtctatgttcgacaatgcggacagcaccattgaattagcccttgtctatccaacccaagcagatgcagaacaaggactggctacatcaacggcaaaagcaagagaagttgaaagcgatccgtgtgacatcagtagccaaattagccaaactgaagatggttttttgttacaagcaaaattcttatttagttgccaagcggaagcggtgatttttcagatgaagttgagatagctcatgcttattgtattaatgaaaaatgatggactatcttgaccgccttattgaacttacccaaattcaaggggaaattaatgtgctgtgccgttttaatggtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattgtgggagaggctcttgggcgaggttgtggatctcgagttacccaagtaccaccttgttctgaggctttacttgagccaacatatactggaatattgctacgcaccgcaggcaacaaggtcgctgggtgtaaaactttcgcaccgaaggttgccatttccgcggcttcgttaaagctcattgtatcaatacgttttgcagcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgcctggcacatcaggccaaattaacacatcatttgcatttaacacttcggctaacaatgctgctgaatagtcactaccgccacgtcctaatgtggttgttttgccttcatcatcacgaccgataaagccttgagtaatagctactttgccttctgcaattaatggtttaaggatagcatctgattgagcttgggttttctcatcatttggtgcggctttgccgtaatggttattggtggcaacaatctctctctcatcaacccatacagcaggataattacgctcttttaatagctgagtgaagattttagtggacatcatttcgccgtggcaaattaattcatcagtgagggctgccgaagtcgcaaggcttgcagagaggctagggctgaaacgtgttctaacaatgcgtcaatttctgcagaaactgccgcagggttttgtaatttttcgataatgttatattgaatggtacgaactgccgctaaaatttcttcacgacgctctgcttcacaaccattcgccagttcaactaaatagtttgttacacctgcggaagcagataacacaacaacccgagtatttgcgtctgcagtaacgatatttgcacaggcagacattgcttcaaaattggcaacgctggttccaccaaatttagcaacagaaagatgagacataaaaatttcctataaataaaattgtgtttgcaatgaagtgaaaaagataggaaatgggatgtttggatgcaggttatggcatacaaaccttgcgtgtcagtatctggttggcagaggaaaacgatagatttttttatggcattgaggaaggcactgatttggaattgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctaatcaatttagcccctaaaaattgtaatgttataataacctactaggtccaaaaggcggagcaataatccaaagatgttttaacggaatattgctaggttctgctgaagaagttcgcaagcagttttgaaaaccataactgccataattctcgctggttaaacattttcctgtgttgggttctgtcagaataaatgctcctgtatctgttgggactaatctaaataaagtgtctgtttgtccacaaggcaaagtaccaccatctccaaccaagcaacgctcttctttatcaactactttaaattgtacgaaccgacgatttttaacaatagcatcgacaagtctccactgcacctctcttggatcattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttaaactgcgtaaagagataatagggggctttatttcaacaacatcaggataagttgatggtgttggcgtaggtgcaggtggcatcggtggtgtttctgcaagggaaaactggcatagtcctaatgtcatcaataaagtaaaacgctttaacatagttcccccttaacgttttttcacaaagctgactgggaaatgatcagaggtaatctgcgatctcatctgattaaacataatgctggcactgaccgtcgtgttttgtgtggtttgattcgcattgtgtaacactgcataatccaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaataagtgggctatccgcccgcttatttgcttatcttatttatagccttaaaacgctacgctctcttttaaacttaccgttaagttaaagacgagattatctgcactaccgtctttactgtctaaacagtaatagccttcacgttcaaattgataaccttgttctgcttttgcattcgctaaacttggctcaacaaaaccttgtttaaccactaacgatgttggatttaccacagaacaaatatcttcttccgcacctggatttgcaacggtgaacaagcggtcgtaaatacggaattccgcaggtttattatgtaatgcagatacccagtgaattacgcctttcacttttcgtccgtctgcagggtttttacctaaggtttcaggatcgtaggtgcaataaattgtagtgatcttaccgcttgcatctttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttttctacatgttccgctttaatcacataagcattacgcaaacgcacttctttgcctaatacaagacgtttgtactgtttgtttgcttcttcacggaagtctgcttcatcaatgtaaagttcacgggtaaacagcaattctcggctgccaagttcttcacgatttgggtgatttggtgcggttagccattcttcgccttcaaagttttcaatcacaactttaactgggttaatcacagccattgcacgcggtgcgttggtatttaagtcattacgaatacaagactctaatgcactgtattccaccacgttatcttgttttgttacaccaatacggcggcagaattcacggatagacccaggggtatagccacgacgacgtaagcccgaaattgtcggcatacgagggtcgttccaaccatcaacaataccgtcatttaccaatttcaacagcttacgtttagaggttaatgtgccttctaaatttaaacgtgaaaattcatactgatgcggtaatggacgttcaatcgaaatgttttctaatacccagtcatacaaacggcggttatcttggaactccaatgtacaaattgagtgagtaatacgctcaatcgcgtccgaaatacagtgggtaaaatcgtacatcgggtaaatgcaccatttatcgcctgtttggtggtggctcgcaaatttgatacgatacaatacagggtcacgcattacgataaatggtgaagccatatcaattttcgcacgcaagctcatttttccttcttcgatttcgccatttttcattttttcgaataacgctaagttttcttcaatcggacgatcacgatatgggctgtttttacctggttcagttaatgtaccacgatattcacgcatttcatcaggcgacagctcatcaacataggctaaacctttgttaattaattcaatcgcatagccgtaaagttgatcgaaataatcagacgcataacgtggctcgccttcccattcaaagcctaaccatttcacatcttctttgattgaatcaacgtattccacgttttctttaacagggttcgtatcgtcaaaacgtaagttacataaacctttataatcttctgcaatcccgaagtttaagcagatagattttgcgtggccgatatgcaaataaccatttggttccggtgggaaacgagtatagacgttgttatgttttcctgaggctaaatcttcatcaatgatatgggtaataaagttggcacgaacatcgtggtgttcgtcgtgtaaaatctcttcgttgctcataatcgctctcttactagtaaaaataacgaaacattctacacgcgattaaggcgaactcaaaatagttagcccaatttgtgataaaaattgactaaaaaactactaacccttacaatttgcttccgcttatgacctactacaagcggtaggattcctcaaaaattttgcaaacacatctctatttaaggaacctaaaatgaaaagatccctttctatcgaattttcccgtgtaacagaagcggcggcactggctgcatttgcttggcttggtcgtggtaataagaatgctgccgacgatgctgcagtaaaagccatgcgttttttgttgaatcaaatggaaattcgtggtgaagtggttattggcgagggggaaattgatcaggctccaatgctttatatcggtgaaaaaatcggtttatgccgtcctgaagatgaagaagtcagcattgcggttgatccgattgatggtactcgtatgacagcgatggggcaagcgaatgcattatcggtattagctgcggggggaaaagaaactttcttacaagcccctgatatgtatatggaaaaattggtagttggcagtgaagctaaaggtatgatcgatttaagccttcctattgagcaaaatctacgtcgtgttgcctctaaaaaaggaaaattactttctcaactaaccgttgcggtgctagataaaccacgccataaagacgttattgctgaaatgcaaaaattaggtattcgtgtgatggcgattcctgatggtgatgtggctgcagcagttcagtgctgtttacctgaagcagatttagatatgttatatggcattggtggtgctccagagggtgtcgtggctgcggcagcagttcgtgctttaggcggtgatatgcaagcgagattaattccacggaaccaagttaaaggtaattccttagagaattttgcttatgcggaaaaagagataaatcgttgcgaagcattgaatgtaccgattaatgaaatattgaagcttgaagatctagttagagatgataatttagttttttctgcgactgggattacttcaggagatttgcttaagggtattctacgtcaaggaaatttagcagtgacagagaccttacttattcgaggacgttctcgtactattcgtaaaattcagtcttatcattatctagatcgtaagcaaacggaatgatatctactttaaagcatggataaatattattacaactaagtttggttttatgcagaaattagtccaacgtcgtccccaattaacagaacaacgattatcagaaaatcctctattaaaccgtatctatcaaagtcgaggggtaaaaagccctgcagagttggatttatctctcaaaggtttacatcaccctaaagggcttgccaatatggaacaagccgtggatttactgttagacagtttaactcgacaagatcggattgtgattgtgggggattttgacgcagatggtgcaaccagtaccgctttggcgattttggcgctacggcagttcggttttcagcaggttgattatttaatccctgatcgcttttcacaaggctatggcttaagccttagtgttgcggaaatggtcatggcaaaaggggcagattttgttttaacggtagataatggcatttcttcttttgaagggattgctttacttaaagctcaagggattcgggttcttgtaaccgatcaccatttacctgcagacagcctgccaaatgcagatgcaatggtaaacccaaatctggccgcttgtacttttccctcaaagtctttggctggtgtcggggtgattttctatgtgatgatggccctgcgagctaaaatgcgtgagctgtgctacttcaaagagaaagagcctaacattgcagaattattagatcttgttgctttaggaacagttgcagatgtcgttccgcttgatcacaataatcgcattttggttaatcagggtttaaatcgtattcgttcagggcattgccgagtggggatccaagcattggcagaggtggctaaacgagatctctatgctttgcaagccagcgatctagggtttgccattgccccaagattgaatgcggctgggcgattagagaatatgtctttgggggtagagctgttgatttccgataatctcgcgttggctcgtcaatttgccctagagctggattcattaaatcagactcgtaaagaatttgagcaagagatgaaagcggaagccttagccctttgtgctaagttgccaacgctctctcagcaaaatcaagcacaaggtatcgtgttatatcaacctgattggcatcaaggggtgattggcatcttggcttctcgcattaaagatcagtttcaccgtcctgttattgcatttgctcaggaaagtgatgatagtgaatatttaaaaggatctgctcgttctattgctgggctgcatatgcgagatttattagaacgtatcgatgctaaatatgataatttgattgtcaagtttggcggacacgcaatggcggccggtttgaccattcatcaagatcatttagctcaatttcaaactgtatttgacgaaaccgtgaacgaagttgcagaacctgaatggttacaaggtgtgatttatacagacggcgagttgttagccgatgaatttaatctagcaacggcagaactactcaaacaagcggggccttgggggcaacattttccagaaccgacttttgaggggaggtttcgtatcttgcaacagaaacttttggctggaaaacatctgaaaatgatggtggaaaatgaatatggtacgctattcgatgcaatctggtttaatgttgatgtaaaatgctatcctgatttatctattaaacaggcaacatttgtttataaattggatattaatgaatttaggggaggaaaaaacctccaactacttattgaatatttattagaagatgatcaattcaaataaaaaaagatagaataagacgattttgtgtagtagaatcatgctaggtttttattatagaaagaagtatagatatttctgataatattctatactaagagatagttaatttgacatttaagggataaagaatgaaaaaaacaattttttttcgtggagtattatcggctatagcgattacaattactgcttgtggtagtttgagtaaggtgtccgatgagggtacaacagaaaaaccggtatttccaaaaattccggaatcaaaatttaatcatgatggctctcaatttggatcatggccgaattgggaaaatgttcgtcaaattgaaaaagggatgaacaaagatcagctttataatttgattggtcgccctcatttttctgaaggactttatgaagtacgtgagtgggactatgcttttaactatagggaaaagggcgtacacaaaatttgtcaattcaaaattttgtttgataaaaatatgaatgcgcaaagtttcttttggtatccaaatggttgtaatggtaattcttcatttaatttagttggtgatttcctctttgattttgataaagatatattaactacaaagggcagagaggttgttgataatgttgcagaacaattaaaatcttcaggtgcagagaaggttaaacttgtgggttacgctgatcgcctaggttctgaggaatataacttagatttgtcacaacgtcgtgctaatatggttaaagctcgtttagtagagcaaggtattaaagtgccgattgaggctgttggttatggtaaagcaaaccaagttaaagcttgtgatggtgaatcaggtcaagcattacgtgactgtttacgtccaaaccgtcgtgtggaaattacagctaatggtggtgtattaaaacagaacgaaagtggtaatgttgcaggtcctcaaggcccagctccgctttatcaaactccttcatataatccagctaaataatttgctgctttgatgtttatgacgtagtaaaataaaagggtcaattcgtaagggagtgaccctttttttgttttataaggagcgaagtaatgtcttatcaagcgattgcattcgaccttgacggcacactgctgtcaagtcaaggcaccattttagaatcaagtaaaaaagcaattaagcaagcacaagagaaaggactaaaggtttatattgtaacgggtcgtcatcatacggcggtacttccttattatgcagaacttgggttagatacccctgttgtctgttgtaacgggacttatttgtatgattttcagaatgataaagtgttatcggctaacccgttaggtaatgcattggcagaaaagttaattcattcagcaaaagcagaagggattcatgttgctgtttatactcgtgatgcgatgacctacgaagtgttaaatgcacatttcaccaaattcttaaaatgggttgtaagttgtcctgaaaatgttcgccctaatgtgtatcaagccgaaaatttccaaacctttattgataatggcacaaccatttggaaagtgttaattagcgatcctaacctagagaaaatgcaaaaatttgtcgaaacattaccgcttgaggtgagtgctgaatggtcttgggtagatcgtgtcgatattactaaagcaggaaatagtaaaggggcttgtttggcagagttattaaaacgagaacaaattgatccagagaatgtgattgcctttggtgataattttaacgacattagtatgttaaaactggttggtatggggattgcaatgggcgaatcagagctggaagtccagcaaagtgcgaaaaaagtgatcggctcaaataacgaagacagtattgctcaaacgctaaatgaattattacagctaaattaaaaggatctatgaatgcatattcgcaaatcagttgaaacggattttgatgctattttagccatttataatcaagcgattccgacccaccaaatgactgcagatctttattttgcaacaagagaaacacgcaaagcgtggtttgaatttcatctatctagtgagaaatatcccttatggacagtggaagatgaaaatggggtaatcggctggtttagcttttccccatattatgaacgcccagcatttgtgcatacttcagaaatcagcctttaccttgatgaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaggtaaaggctatggctcgaaaattatccagtatatgcaagataagatgctagagcatgggattcatactttgatggcgtatgtttttgaattaaatcaagtaagtatgaatttaatgaaaaaacacggctttgagtgttgggggcgttttccaaatattgcgaatatggggaaagacagcgatggtaatgaaaaatggcgaacacttgtaatgatgtcttatcaaaagggcattgaatagcggtaggattttagaaaaaatttgcaattttggtggaaaacatttgcatattgaagccgaattttgcaagctatcgtattatttaacaaaaaagatatacaggagaaaattatgtcaaaacctcttttttcaggcagtattgtggctttgattaccccaatgaaacacggagaaattgactttgatggattaaaagagttagttgagtttcatattaaagcggggacacacgctatcgtttctgttggtacaacgggtgaatgtagcacattaagtattgacgaaaatgtgaaagtgattaagaaaaccgttgaatttgcagcaggacgcattcctgttattgcaggtacaggttcaaacgcaacaagtgaagcaattacaatgacaaaattgcttgcagacagtggtgttgctggctgtttgagtgttgtaccttactacaataaaccaacccaagaaggtttatatcaacattataaagcgattgcagaatgtacatcgttacctcaaattttatataacgtgccaggtcgtacgggaacagatttaaaacctgaaacaatcgcacgtttagctaaaattccaaatatcgttgcagtaaaagaagcaactggagatctgagccgtgttgcacaaatcaaagcacttgctggcgaagattttatcttcttaagtggcgatgatgcgactggtttagaatcaatgaaattaggtgggcaaggtgtgatttctgtaactaataacctagctgcggcagatatggcaaaaatgtgcgaacttgctcttgaaggtaaatttgatgaagcagaagagatcaaccaacgcttaatggatttacatacaaatctgtttgttgagggcaacccgattccagtgaaatgggcagctcataaaatgggattaattagtgatccgtgtttacgtttaccgcttacagtattatctgaacagtatcatccagtaattactgcagcattacaaaaagcacaattaatctaaaatgttctaagtcaaggttggttttccagccttgatttttttgtaaaaacttagcgaatcttaccgcttgttttctaccaaaatcttccaaaatcgcttataatctcgccctttcaaacttaaatgaattaaaccgaatttatttttaaaaatcttaaggtaatacaatgtcagaagtcgaaaaccaagaattagatctcaatggcgaaatgatcgctcgccgtgaaaaattagctcagttgcgtgagcgtggtaatccgttcccgaacacattccgtcgtgaagataaagcggaagatcttcacgcaaaatatgatgaagttgatggcgaagcacttaaagctaaagaaattcctacggtagttgcagggcgtattatgttacgtcgtgtgatgggtaaagcgacatttgttactattcaagatgtcagcggtcagatccagctttatgtggcttgcgataatttgcctgaaggtgaatatgaaaacaccgtgggcttattagatttaggcgatattatcggtgtaaaaggtacactatttaaaaccaaaacaggtgaattaactgttcgtgtagccgaattacaactgctcaccaaagcgcttcgtccgttaccaaacaaacataaagggttaacagaccaagaaactcgctatcgtcagcgttatttagatcttattgcgaacgaagaatctcgccgtgcctttgttatccgctcaaaagtggtatcaggtatccgtcaattcttcttagagaaagattttatcgaagtggaaacgccgatgttgcaggtgatcccaggtggcgcagcggcaaaaccctttattactcaccataacgcattagatgtggatatgtatctgcgtatcgctccagagctttacttaaaacgccttgtggttggcggttttgagcgtgtattcgagttaaaccgtaacttccgtaacgaaggggtgtctgttcgtcacaatcctgaatttacgatgattgaatactaccaagcctatgcagattaccacgatttaatggataacaccgaagaattattacgcaaattagccttagatattttaggtacaacgaccgtgccttacggcgaatatgtgtttgatttcggtaaaccgtttgaacgtatcacaatgcacgaagcgattgtgaaatatggcaacggtatttcaatggacgacctacacgatttcgacaaagcagtggcaattgcaaaaggcttaaatatcgaaatccaaaaatcgtggggtttaggttctatcgtcaatgcgatttttgaagaagtagcagagcatcaattaattcagccgaccttcttaatggctcacccagcggaaatttcaccgcttgcacgccgtaatgatgaaaatccagaagtgacagaccgttttgaattatttatcggcggacgtgaaatcggtaacggcttctcagaattaaatgatgctgaagatcaagcggaacgtttccaagcacaagttgcagcaaaagaagcgggtgatgatgaagcgatgttctacgatgacgatttcgttgtcgcccttgaacacggtttaccaccaacagcaggcgaaggcttaggtatcgaccgcttagcgatgattttcgctaacgcaccgtcaatccgtgatgtgatcctattcccagcaatgcgtcagaaataggtttaaacaagtggggacacactgcgtgtgtccgtaataaaaatattcaaagtgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaagacgaagtgtgacttatataaatagacgccaagcgtggcgtccctacttttataataatccgttgggacacacgcagtgtgtcccaactgtgttacctgccacatatttgaggtcaaaatgcttgccattatttccccagccaaaacccttgattttgaaactaaaattgacggatttgtattttctcagcctgaactaaccgcttacagccagcaattaattgatatttgcaaacaattttcccctgcggaagtggcatcattgatgtcaattagcgacaaactggcaagcctaaatgttgctcgttttgccgaatggacaatggaacacaatgagcaaaacgccaaagcggcattatttgcttttaaaggtgatgtttatacgggcttagaagcagaaacactaaccaatgctgaaatcgactatgctcaacgccatttgcgtatgttatcggggctatatggcttattaaaacctttagatttaatgcagccgtaccgtttagaaatgggaacgaaattggctaacccaaaaggcaaagatttatatcacttttgggataacatcattactcaacacctccagcaagccattgatgcacaagaagataacatcttagtcaatcttgcgtccgatgaatacttcggggcggcgcaagcggagagattaaccgcaaaaattgtcaaacccgttttcttagacgaaaagaatggcaaatacaaagtgattagcttttatgcgaaaaaagcccgtggaatgatggtgcggtttatgttgcagacccaaccaaccagcgttgaacagcttaaagcctttaattatggtggctattggtttgatgaaacggcttcaacagacaccgaattggtgtttaaacgtgaggaacaatagcataatgttacgaaactagttgttattctattggaataatttcttaatatataaattttcaaaatcttgtacacgttttattgaaaagtactggttttttgcttcagattcaagtaaaatccgcccgttttttgtccttgcagattaatgtaggcaaaaaacattttattttttattcactaaatcacacacatatcgcagactaagcgtcggggtgctgttgaaaaacggtcgatgacttaggatatgtggaggcaaaaccctttctgccgcggcagaaacaacaacaaggaaactattcttatggcacaagtatctatgcgcgatatgcttaacgcaggcgttcacttcggtcaccaaactcgttactggaacccacaaatgaaacctttcatcttcggtgctcgtaacggtgttcatatcatcaacttagagaaaacattaccgttattcaacgatgcattagcagaattaactcgcattgcaagcaacaacggtaaaattcttttcgttggtacaaaacgtgcagcatctgacgcagttaaagcagcagcagtagaaagccaacaattctatgtaaaccaccgttggttaggtggtatgttgactaactggaaaacagttcgtcaatcaatcaaacgcttaaaagatttagaagcgcaatcacaagacggcactttcgacaaattaacgaagaaagaagcattagaccgtactcgtgatatggctaaacttgaattaagcttaggcggtatcaaagatatgtctggtcttcctgatgcaattttcgttatcggtgcagactacgagcatatcgcaatcaaagaagcaaataacttaggtattcctgtatttgctatcgttgatactaacgcaagcccagctggcgtaaactacgttatcccaggtaacgatgatgcagcgcgtgcgatccaactttacttagatgcagcagtagcagcaatcaaagaaggtcgtggtcaagaaaccgttgctgctgaatttgttgcagaagaagcggctgagtaatcgtctttaaggcaagcccttaaaacacattcaacattgtgaagcaggggcaattatacccctgcttttttatctattaagagaggaataaaaaatggctgaaattacagcagcattagtaaaagaacttcgtgagcgtactggcgctggtatgatggaatgtaaaaaagcgttagtagaagcaaacggtgatatcgaattagctatcgacaatatgcgtaaatcaggtcaagcgaaagcagcgaaaaaagcaggtcgtgtagcagctgaaggtgttatccttgctcgtatcggtgcaggtttcggtgtgttagttgaaatgaactgcgaaactgacttcgtagcaaaagatgcaggtttcgttggtttagcaaacgaagtggcagattatgcacttgcaaacaaagatacatcaatcgaagcattacaagcacaattcgaagaaaaacgtgctgcattagtggctaaaattggtgagaacatgaacatccgtcgtgttcaatacttagaaggtcaagtgattgcacaatacttacacggtgcgaaaatcggtgtattagttgctggtcaaggtgctgaagaagaacttaagaaagttgcaatgcacgttgctgcatctaaaccagatttcgtaaacccagaagatgtttctgctgaagtggttgctaaagagcgtgaaatccaaatcgaaatcgcaatgaactctggtaaaccaaaagaaatcgcagagaaaatggttgaaggtcgtatggcgaaattcactggcgaagtttcattaactggtcagccattcgttatggatccatcacaaactgtaggtgcttacttaaaatcagttaatacctctgtagctaacttcgttcgtttagaagtaggtgaaggcattgagaaagttgaagaagatttcgcagcagaagtagcgaaaatcactggcggtaatgcttaatttctctttgagataaaataacatccgcatgttttgtatgcggatgttattatgggttatttaataaaatacaaacgattaccccccgaatagactgttgcctttccttttcgagtaaaagcgagtagtgtaaagtcgttttcccttgcgatattgactgccatttcagtggtagccgaaatcgcacaaagcatttcaataccacaagctaaacatttttgtaccatttcaaaactggctctgcttgtgacaaacacaaagccaagtggggcattttcttttgcataccagcctaacagtttatctaaggcaacgtgtcgccctacatcttctctgatagctaagagtgtgccgtcagggctaaaaaaagcggctgcgtggcttgctcctgtttctttagcaagagtttgagcctgttctaattgagccaaacaatcatctaaaatcaaaggggaaatgtttgacaagcggtgcgattgtggaaaagtttggtaactctgtttgacttgttcaagttgttcaaccccacagatgccacagcctgttctgcctgccattgaacgacgtttctctttcaattgagtgaattgacgagtggaaatttccatttggatttcgatgccgttacaactttcaataatgtctaagccgtagaggtcgcttttctgttttaaaatcccttcggcaagggaaaaacctaaggcaaaatcggctaaattgtcgggggtacacatcataactgtatgtgaaattccattataaacgagagccacaggcacttctctgatgatgttatcttgttgaaattgctgttgtagagaaccgttctcaacaaaaagtcgatctacatcaaatttagtgatcttcttcacattattcctcgaaaaaatttgtttattaagtagtttattttgttaaaaaattgtatcatttacagaattttagcttatatcaaatagatggtaattaatccgtaatagtgctgctttttaagttggtttagtaggataatatcattaattattttgttaggttgttaaaactattttataaggagttaaattatgttatttattaaatttttagtttttattttttgcctatcatctgtaatatttctgattttggcattttttcaggcaaaaaagcaaaggcaagaacaaaagaaaaagcaagagttattttttaggaaaataaaaaataactattctataataaaaatttccgatgatgtttactattataaaggggcgtatttaacagaaaaatatctgatacataatgattgcaaaataaggcattatcaggattttttatttgcttatcgccttctaaaattcatttagtatttaatcctagttaatagacaaaattttattatttattaataaacaccgcaaatgcggtttggagtgatttatgcaggtcagtagaagaaaattcttcaagatctgtgcaggtggtatggcaggtacgtctgctgctatgttgggatttgccccagcaacagcattagccgcacctcgtgaatacaaactattacgagcaaaagaaactcgtaacacctgtacttattgtgctgtaggctgtggtatgttgctatacagtcttggcgatggagcaatgaatagtcgtgggaaacttattcatattgaaggggacccagaccacccagtgagccgtggggcgttatgtccgaaaggtgctggtgcgttagattatgtaaatagtgatcgccgtgtacgttatccagaagtgcgtgaagcaggctcaaaagagtggaaacgtatttcttggcacgaagcaattgagcgtgttgctcgccatatgaaagatgaccgtgatgctaactttattgagaaaaatgaagcgggtgaaacggtaaaccgttggatgacagcaggtttcttagcaggctctgcgtgtagtaatgaaacgggtattcttactcaaaaatttgtacgttctctcggtatcgtttttactgacaaccaagcgagtatctgacacggaccaacggtagcaagtcttgctccatcatttggtcgcggtgcgatgactaaccactgggttgacattaaaaacgctgatctcgttattgtaatgggcggtaacgccgcagaagcccaccctgttggcttccgttgggcgattgaggcgaaaaaacagaacggtgcgaagttaatggtggttgatccacgctttaaccgtactgctgctgtggctgacatttatatgccacttcgtccaggtactgacattgcattcttatcgggtgttattcgttatcttttagaaaacgataagatccaacacgaatacgttaaacactataccaatgcgacattcttagtgaatgaaaactttaagtttgaagacggtttgttctcaggttatgaccctgaaacgcgtaaatacgaccgttcaacttggggttatcaatttgatgaagaagggcaaccaaaacgtgatatgacaatgcaagatccacgttgtgtgatcaatatgttaaaagaacacgtttcacgttatacgcctgaaatggttgaacgtattacgggtacaccacaaaaagatttccacattttctgtgaagaaattgcaaaaactgcggcgccagaaaaagcggcaactttcctttatgcgttaggttggacacaacatacagtcggttcacaaaatatccgtactatggcaattatccagttgttattaggtaacatcggggttgcaggtggcggtgtgaacgcattacgtggacactcaaacgtacaaggtatcaccgacttaggtttattcccaaatcgtttaccggcttatcttccattgccaacggaggcggatagttctttagaaaaattcttaggacgtattacgccgaaacaaatgatgaaagatcaggtaaactattgggcaaatacaccgaaatttatggtgagtatgctgaaatccttctatggcgacaaagcaacgaaagataatgaatttggctaccattacttgcctaaattaccaaaaggcggaatggatcatatgcgttacattgaagaaatgtatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaatttaacgacgtgaaaaccgaagaaattcaaacggaagtattccgcttgccaaccacctgtttcgttgaagaggacggctcaattgctaactcaggacgttggttacaatggcactggaaaggggcagaaccaccaggtgaggcgaaaacagacggcgaaattctctctgaattgcgtgcggaattgatccatctttatcataaagaaggcggaaaagcaccgcttgagccgttagaggcaatgagctgggattatgcaaatccacttgagccaaaagcagaagaagtggcaaaagagaataacggctatgccttggaagatttatatgacgccaacggcaacttaatcttgaaaaaaggtcagctactttcaagctttgcacaaatgcgtgatgacggtacgacttcaggtgcgtgctggatctacacgggtcaatggacggaaaaaggtaaccaaatggcaaaccgcgataactcagacccatctaacttaggtaataccctaggttggggctttgcgtggccaatgaaccgccgtattatttataaccgtgcctctgcggatttatcaggtaaaccgtggaacccgaaacgtcagcttgttaaatggaatggcaaaaactggaactatgtggatgttgccgactttggtgctgcaccgccagatagcccgacattgccatacattatgcaacctgaaggggtaagttgtttattcgtgcgtgagcgtatggttgatggtccgttcccagaacactatgagccaatggaaacgccaatcggcacaaacccattacaccctaatgtggtttcaagcccagttgcccgtattttaccaacggataaagaagaactcggtacttcagcagagttcccttatgttgcgacaacatatcgcttaacggaacatttccactactggacgaaaaatgctctcttaaacgtgattgctcaaccggagcaattcgtggaaatcggcgaggcactcgcgaaagaaaaaggcattaataacggtgatatggtgaaagtcagctctaaacgtggctacattaaagcggtagcagtggtgactaaacgtatccgtgcattagtgtcagatggaaaaccaattcacactatcggtgtgccgatccactggggctttgcggcaacaacaggtgctaaaaaaggcttctttgccaataacttaacggttcgtgcaggtgatgcgaatacacaaacgcctgaatcgaaatgtatgttagtcaatattgagaatattgtgggggcataatatgagtacagttcaatctcaagatattattaaatcctctgcaatttcattcttgacaccaccgccacaggcgcgtagccatcaagtggaagtggcgaaattgattgatgtcaccacttgtatcggctgtaaagcctgccaagtgggctgttcagagtggaacgacattcgttcaaccctggacgcagcttgtaccggggtctatgacaaccctgcggatctcaatccgcaggcttggacggtaatgcgatttaacgaagtggaagaaaacgaccgtttggaatggctgatccgtaaagatggctgtatgcactgttctgagccaggctgtttgaaggcttgcccatcaccaggtgcaatcattcaatacgcaaacggtattgtagatttccaatcagacaaatgtatcggctgtggttactgtatcgcaggctgtccgtttaatattccacgaatgaaccctgaagatcaccgtgtgtacaaatgtacactctgtgtggatcgtgtcactgtgggacaagagccagcttgtgtgaaaacctgcccgacgggtgcaatccgctttggtagcaaagaagagatgaaagaatatgcgtctaaacgcattgccgatctcaaatctcgtggctacgaaaatgcaggcttatacgacccagaaggcgtgggcggtacacacgttatgtatgtgttacatcacgcagacaagccagagctatactcaggtttaccgaaagatccgcagattgatttaagtgtcaccctttggaaagacgtactcaaaccagttgctgcagtggcaatgggcggcttagttctttctgaaattgcacactatatcgcaatcggtccaaatacagaagatcttgacgaacacgaagaacactacgatgaacagggtgaagaacataaaggaggcaaagatgagtaagattcaaatccctaacgattaccgaatcgttcgccataaattgcctgctcgttggagccactggttactcgtgatctgcttctttaccacaggcttatcagggttagcattcttcttccctgattttgcgtggttagtggatattttaggtacaccacaattagcacgaatgatccacccattcacagggattattatgttccttgctttcgtaaatatggttcgtatttactggcatcataatattccagagaaaaatgactgggtatggttagttaacattgtagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatgtggcgtcaatatttcgcacataatttctcaattccagtaattcgtattgcgatcttattccactcagcttgtgcctttatgttgttcactggcatcatggtgcatatgtatatggcattctgggtgaaaggttcaattcgaggtatggtagaaggttgggtaacggttcgctgggcgaaaaaacaccacccacgttggtatcgtgaagaagtgttacctgaacttgaaaaagagtttgcgaagaaacggtaacgtcaaattaaatgtaattattgtatgccgatcatctaaatagttgatcggcttttttctttttaaagaatctgtttttattttgactgttttgtagcttaaaaattaagctaaattaaaattttattaattttgtagtaaattcaattgtaaacgtaaatgaaaactttattcttattgataataagttttatttatttttattcataagataaaatcaaggagctttctatgcgtttaaaatctctcacccttgcgatttcaagtttatttgttgccacttccgtttttgcaacggatttatctaaagaaacacaaacttataaggaatttgtagttgggcaaatcgatcaattagtgacagataccgagaaatttgtggggtatttgaaggcaggcgatgtggaaaaagcgaagcaaatctatccgcttgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccgcttgcacgtatgtactttgagcgttcagagccgattgcagagagttttggcgatttagaccctcgtattgatgctcgtcttgcggatttaagtgaagaagggcaaaccgagaaagattggtcgggtttccataaaattgagaaagtgctttgggagcaaaataccacaaaaggcacagaagcgaccgctgatcagttgatcaaagatgtgaaagaactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatcaaagatgtgaaagaactgcgtgcgaaaattccaacggcggaagtcacccctgatttaatgattaccagtgcggtggatttgttaaatgaagtatccaccacaaaagtaacgggcgaagaagagattttttcaaaaactgacctttatgatttcaaagccaacattgaaggggcggaaaaaaatttatgcgatctttaagccaaaattagagcaaaaagatgcgaaattggcaaaagagattgctgatcgcttccaagatgtgaatgtgttattggcgaaaaagacagggttacagatgttaagacgttctttctcttatgccagcggtgttgagtcgaaaacggggcagtttgatgcaggcttgttgtttatctcgttccaaaaagatccgcaacagtttatcaccattcaaaacagccttggcaacatcgacaagatgaacgaatacattacccatatcggtagcggattatttgcgtgctttgcaggagttaaagatgaaaatgattacttgggtaaatcattgtttgaacagctttaaccgcttttttgccatatttacgctcagcctaacgctgggcgttgcttatgcaaaggtggataccggccacttatttgtgcatttatctgatgcgatggaagtcgttccctatcttttaggcagtgccgcaccgctgagttagtataaagtaattcatctttgtttacgttttatttacaaagttaaaccctgtatttcaaatgaaaattttttattcatatgaaaaattttttaaatctatcatttttatttaacttattgatttttaaccattggagcttttctctatgagattatgatctatatcaaaaattgagattgttttgtaaagctatttttaatagaatgctacgcaaacgtttatttcatcattcccagcgtatataaattagccaaggagagtaaatgaaagaaaaagttaaaaataccacctcactcaagcaagataatcaattcatagaacagcttgcgaacgggtgttgccaagatccttttgcttatttaggggttcatcaagttgatgatggcgtgattgttcgggcttatctacctgaagcagaacaggtaacagttattaatgataacagtgagccgattgtgcagatggaacaaattgacgatcgtggcttctttgctgcgaatttggttggtgaaaaaactgacctttcctaccgcttgttagtgcgttatgcccacactgaaattgatattgaagatccttaccgtttccagtcccatttttccgatttagataattggttgctttctgaaggaacccacgttcgtccttatgaaaaattaggtgctcatcttgttacccaaaatgaagttggcggtattcactttagcctttgggcgccgaatgctcgccgtgtatctgtggtgggtgattttaactattgggacggtcgtcgccattcaatgcgttttcatccaaacagcggtatttgggatatttttgtaccaaacttgccaaaaggaatgctctataaatttgaaattttagatagaaatggacaaatccgtttgaaatcagacccttatgcgttctcagctcaattccgtcctgacacagcttctgttgcttctggtttacctgcgattgttgagagtgacgaggaacgtcgtcgtgcgaacgatcctgatcagccgatttctgtctatgaagtgcatttaggctcttggcgacgtaatttagaaaataattattggctaaattatgaagagattgcgaatgagttaattccttatgtgaaggaaatgggctttacccatattgaattattaccagtcacagagtttccatttgatggctcttggggttatcaaccaacaggaatttatgccccaaccagtcgttttggttcacctgaaggtttacgcaccttaatcagtaaggctcacgaagcagggattaatgtgattttagattgggtggtagggcatttcccaaccgatgaacatagtttggcgtattttgatggtactcatctgtatgaacattccgatccaaaagaaggttatcaccaagattggaatactttgatttttaactatggtcgtcacgaagtgcgtaactatttgacgggtaatgcactttattggattgagcgtttcggtattgatgcgttgcgtgtcgatgcggttgcctcaatgatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcaatgatttatcgtgattactctcgcaaagatggcgagtggatcccaaatcgctatggcggtcgtgagaatttggaagcgttagatttcttacgttcaacgaatgatatgttagcgaaagaaagcaaaggcggtgtgactattgcggaagagtccacttcttttgctggtattactcacccaacggaacatcacggcttaggctttgattataaatggaatatggggtggatgaacgatacattacgctatatgaagactgatccgatttatcgtcaatatcatcacgatttaatgaccttcggtatgatttatcaatatagcgaaaaatttatgttaccgctttcccacgatgaagttgttcacggtaaatgttcgttactcggtaaaatgcctggggattgctggcaacagtttgcaaacctaagagcatattacggttatatgtggggttatccaggtaaaaaactgctctttatgggcaacgagtttgctcaagggcgtgagtggaattatcaagagagcttggattggttcttgcttaacgatgaacacgatggttggcataaaggtatgttgaactgggtgcgtgatttgaaccgtatttatcgtcaatatccagcactgtatcagttggattacgatcctgctggctttgagtggttggtggttgatgatgcagagcagtctgtgtttgcctttgaacgtaaagcaaaagagggagcaagcattattgtggtcagtaactttaccccgatccctcgtgataattaccgttttggcgttcacgaagatgcggaatataaagaaattctcaactctgactcagcttactatatgggcagtaacttagggaatttcggtactattcaatgtgaagagattgagtcgcacggtaaaccttattccatttcgctcactatcccaccgcttgcgacgatttttatcgtcaaagaagccaaaccacaagcggtgaaaaaagcgaaaaaatctacaaaagtggtaaaaaaagcggaagagccgaaagtggaaaaagtcaaagcagtaaaagcgaagacggaaggtaaagctgttaaaacgaaagcaacaaaagcaaaataaggtagggacacactgcgtgtgtccattaattacaaatctaataattcaaatgttctacattatgtagtagttacaaaaagttgattaaattcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgaaggcggaaggggggatattattgttctcccctcagggcttcgcccagctccccccgtaaacagggggagcgaagatttcaaataatataattgtttaagatgtcggacacacgcagtgtgtccctacaataagtactaaggctgtatatgaagtaccttgcaggcagaccatttccattaggtagccgattaactgaaataaatggagaaaaaggcgtaaattttgcattgttttctcgccgtgcaagcggtgtggaattagcaattttttgcgacggtaaagaaattcgtttaccgatgatcaaaaccgatgaaatttggcatttgtttgtggtcggtctaaaagcagggacgcaatatggctatcgggtaacagggtgtgtaaatgaagaaaaaggcgacctgtttaaccccaataaattactggtagatccttatgcgaatggcattgtaggacaacctgatttatccagtgatgaagcggtgaaatggtttcagtggaatgatccgagagataatgctcacctagccccaaaatctgtcgtggttgcacgagatacttttgattgggaaggtgactataaaccttttaccccttgggctgaaacgattatttatgaaacgcacgttaaagggtttagtaaacttaatcctaaagtgccaagcgaaattgcaggcacttttgcagggttagcccacgaaacgtcaattgctcatttgaaacgtttaggggtaacggcagtggaattgttgccgattacctatcatattgatgaaccgcatttgcaaaaaatcgggttatgcaactattggggttataacgttttagggcattttgcggttgatcctaaattagcttataacaaagccgatccgctaacggaatttaagcagttggtcaaaacgcttcataaagcagggatcgaagtgattatggacgtggtctttaatcatacggcggaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaaagatggtccaacgctatctcagcgtggcattgataatgaagcatattattggcttactgataatagtgactatctaaactggactggctgtggcaatacgctcaatgtgtcgtctgatgtggcggtgttgcgttgggtgattgattgcctctgctattgggttaaagagtgtcacgttgatggtttccgttttgatttaggggctgtcttaggacgttctccgacgttttcggaaaaatccgccttttttacagcgatatatagtaattcaaaattatctcacgttaagttgattgcagagccgtgggatattggctggagtggttatcaattaggggcattccctaaaccattcgccgagtggaacgaccgtttccgtgatgatatgcgtcgtttctttttgcaaacaagcggtgatttagggctgtttgttcgccgatttgcaggcagtgatgatatttttgctcgccatcgtttaccttcaaacagtgtcaattttattaccgctcacgatggttttactttgcacgatttagtcagctataacaaaaaacataatttggcaaatggtgaacaaaatcgagatggacacggaaataatatcagccataatttcggggtagaaggcgataccaacgataaaacgattattgagcaacggcagttagcgaaaaaagctctgctggcgacgatgttgctctcgagcggaacaccgatgttgttggctggtgatgaattagggcatagccaacaaggtaacaataacagctattgccaagataacgagattagctggattgactggcaaaccgctgacgaagcattgattgattatacgtcaaagctgattgctattcgtaagcagatccctttgttatctcgtgataatcaatggtggtctggtgaaaaagttcagtggctacgccctgatgcgaatgttattcaatttaaagattggcaagactattcaaccaaagccttacaaatactattagaagataaatggcttattttggtcaatgccaaacaagcaatgcaacaatttttattacctaagggtgattggcaaatacttttaggtgaaaaagaaaccactctaatgaccgatacgcttgcagttactctcaatcacattgaggtatgtgtacttcaaaggaattaatattcaccatcccaatttggagataacaatatgctaaaacaggaagcatcaactgacagacgtaatcttactgcacaaactttagttcttatcttagcaggcggtcgtggttcacgcctttatgaattaaccgacaaacgtgcaaaacctgcggtttattttggtggtagccgtcgtattattgacttcgccctttccaactgtattaactctaacttattgaaagttggggtgattacacagtatgcggcgcattcactactccgccacttacaacgtggttggtcattcttaccttatgagcgtaatcaatacattgatatgcttccagctcgtcaacaaattgatgagaacacttggtatcgtggtacagctgatgcggtttatcaaaatatggaaatgatgaaatcgcactatcgtccaaaatatgtgattattcttgcgggtgaccatatctataaaatgaactacaaccgtatgcttgaagatcacgttgattcaggggcaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaccgtaggttgtatcgaagtgccacgtgaacaagcaacggaatttggtgtgatggcagttaatgaaaaattaaaagttaaagccttcgtggaaaaaccgtcagatccaccagcaatgccagacaaaccagactcatctcttgcgtctatggggatctatgtgtttgacgcagattatctctatgaaatgttagaaaaagaagtcagcaacccagatacttcacacgactttggtaaagacattattccaaaagccgttgaacaaggtgtgatttatgctcacccatttgagcgttcttgcgaaggtcgtaacacaacgggttcgatctactggcgtgatgtgggaacaatcgacagctattgggctgcccatatggacttagtcagcgaaaaacctcaattagatttatatgacgaatcttggccgatccacggtcgtccacaacaaactgcaccagctcgtttcttctataaaaaagcgcgtgcgcatacccttgataactcattgattgcagggggctgtgtgattaccgatgcagagatcagtaattcagtactttttagccgtgttcatgtccatgaagattccattattgaacaatctgtgatccttccacaagtgaacattggtaaaaactgtgtaattaaacgtgcagtaatcgaccgtcactgtgatattccagatggcttacaaatcggtgtaaatcctgaagaagatgcgaaatatttccgtatcagtaaaggtggtattgtcttagtttgccaaaaaatgttagacaaattggcaaaagataaagcggttgcttaatatgtagggtgggtcttgacccaccttttaaagtttatctatgagcggtgggttaaaacccaccctacatttattcacaacatcaatatagttaattaaatgaaaattttacatatttgttcagaaatgtacccgcttatcaaaactggcggacttgctgatgtgatgggggcattaccctatgcacaacaatcagctggaaatgatgttcgagtattaattccttattatccacaagtggcttccaagttaggcgaaaccgttgaagttgcgaccgtcggtacctttgcaggtgttgtcactgttcgttttgcttatttgaatggcttaggcgtatatgtgattgatgccccacatctctttgatcgtcgtttaccttactacgacgacaactaccaagattacaccgataactacaaacgttttgcactattaggttatctcggagcacaacttgcttcaggtttagatcattggtggggcagaagtgatgtgttacacgctcacgactggcaagcaggtttagcttgtgcttatctcaaaagctggaacagccctgtgaaaagtgtcttcaccattcacaatatcgcctaccctggacgtttccaagcctaccacttagcagaattagccttgccttgggaattttataatgttcacggtttagaattttacggcgaaatctcttatctgaaagcaggtttattctacgcagatcgtgtaacaaccgtaagcccaacctatgctcgtgaaattactgagcaaattgcaggggcaggaatgcacggcttactgcaacaacgccttgcagaaggggcattgcgtggcattttaaatggcgtagatgatgctgtttggaaccctgaaaccgacacaaacatcgtggcaaattaccgcccgaactatatgcaaggtaaaggtaaaaacaaatcggaactacaacgttactttggcttgccagaagataaagatgcactcttatttgtgatggttactcgcttaaccgaacaaaaaggggcagatttcttacttgcacgcattgaccaaatgatgcaacacaacgttcaacttgtagtgcttggtagtggatcgcctgacttagaatgggcattgcgtgatgcacaatctcgttacccacataaaatcggcttaaaaattggttatgatgaagctctttcacaccaaattatcgcaggtggtgatgttatcttagtcccaagtcgctttgaaccttgtggtttaacccaactttacggcttaaaatacggtactctaccattagttcgccgaacaggtggtttagccgatactgtcaatgacgcacacaaagaaagcattgaaaaccgcacagcaacaggatttgtgtttaactatcctgacgcagataatttctacgatgccgtactgcgtgcgatcaatttatggggtaaaaataaattgtggtcgagtgtacgccaaaatgcccttgctcaagatttcggttgggcaaaagtggcacagcagtatcaagagttgtattacgagattgtctaacaaagatagatgggctaatagcccatctttttggcaaaaaatttaacaaatctaaccacttgtaaatttacaactcaactaaatctctgtataatccgctcgcaatttttccagttttattttttaactttcaaattaaggaactattgcaatgctacgagtaattaaagaagcactgacttttgatgatgttcttcttgtcccagcacactctaccgtgcttccaaataccgcaaacctttctactcaacttaccaaagacattcgcttaaatatcccaatgctttctgcagcaatggataccgtgacagaagctaagttagcgatttcccttgctcaagagggcggaattggctttatccataaaaatatgtcaattgaacgccaagcagatcgtgtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacgtggcaactgctgaaggtgcgattgcccttgctgatgcgggagcaagcgcagttaaaattggtatcggtccaggttcaatttgtacaactcgtattgttacaggcgtaggtgtgccacaaatcacagcaattgctgatgcggcggaagccttaaaagatcgtggcattcctgtcatcgcagatggtggtatccgctattcaggcgatattgctaaggcaattgctgcaggtgcatcttgtgtaatggtgggttcaatgtttgcaggcacagaagaagctccaggtgaaatcgagctttaccaagggcgagcattcaaagcctatcgtggaatgggatcattaggggcaatgtcaaaaggttcatctgaccgctatttccaatccgataatgccgcagataaattagttcctgagggtatcgaaggtcgcattccttacaaaggcttactcaaagaaattatccatcaacaaatgggtggtttacgctcttgtatgggcttaactggctgtgcaaccattgatgaacttcgcaccaaagcacaatttgtccgcattagtggtgcaggtatcaaagagagccacgttcacgatgtaaccattacgaaagaagcgccgaactatcgaatgagttaattttttgctacgcttggtgtcctgctttattcgatggacaccaagcgtgatgccccttgtttctttctttgatacataatactgaaaacaagcggtaaaataatgggaaaatcttaccgctaacaaggaatataaatgcctttaatcagaaaaataacaaataaaatcaacgatttttttcgcaaaaaacacaacgccaaaaatcgccaacgattaaacactaacaccctgactgtaattgctagtaactgcacaggggcttttatgttgcacgatttaggtttacgctttaattccccttttgtaaatttatttttaacccccactgattttattaaatatgtaaaaaatattgcccactaccaaacccaagaaatcactttccccaaagaaattcaaagaaaataccccgttgggctactaggcgatattcacatttattttatgcactatcattcagagcaagaagctgttaaaaaatggcaagaacgcaccgctcgaatggatctcaataatcttttcattatgatggcagagcgagatggctgtcgctatgaagatctgcttgaatttgaacaactaccgtttaagaataaagttgtctttacccataaaccgtatccagaactaacctccgcagtttatattcaaggctttgaacaacagcaaaaaataggcgatctgtttgagtattgcggtttgaatgggaaacgtttttactatcagtttgattatgttgggtggtttaatcagcataagcaaaactaagttagcaatttaataatggttgaaaatatggacatcaaactttttgaacacaaagaagtacgttccgtttgggacgaagaacaagaaaaatggtatttttcgattattgatgtaatcgaaattttgacggaacaacccaattatcaaggtgcaaggaactattggaaagttctaaaaagccgtttattaaaagaaggaaatgaaacggttacaaattgtaaccagttgaaaatgagagcggaagatggcaagttacgactaactgacgtagccgatgtaccgcaactactgcgcttaattcaatccattccgtccccgaaagctgagccatttaaactttggttagctcaagtgggaagtgaacgtttagatgaattgcaagatccagaacttactatcaatcgagcaatgcaggattacttgcgattaggctattcggaaaattggattaaccaacgtttaaaaagcattgaaatccgtaaggaactgacggacgaatggaaacgtgtcggcgtaaaagaaggtcaacaatttgccgttttaaccgatattatcactaaagcgtggagcggaaaaaacaccaaaaaatataagcaattcaaagggttaaagaaagaaaacttacgcgataatatgacgaacaccgagctcattctcaatatgttagccgaagcctcagttaaagatatttcacaagcggtgaaccctgaaacctttgaagaaaatcaaaaagtcgccgaacaaggcggcaatgttgccaaagtcgctttacaagagttagagagcaaaacgggtaaaaaagtcgttagtcagatttcagccaaagcgatgttggcggaaagtaaaaagaaattaaaataaagtgcggtcggattttgcaaaattttatataaataataccgcttattccccgcacggcaagcagtacggggttacgcataagtcagctccgttggagatggaagtgacaaatgaacaaagagctacgaagtagctcaattatgcttaacctagggcgtaagccctaggataaatacaatcaaaaatttaaggagtctttatgcttacattacaaataattgatggtattttaggtgctgttcttattggttatcttctctttctttttattcgtaaagtttttaggatatattggacgaaattcaaatttgatatattttctaaaaaaatctttattattgaagcaatcattggggttttatttacttctggtattattatttctgaagtatccatagataaatggaatggatatactctttgcttactatcttcattaatttttataggcttgctaacttatatttatagaaaaacagactttaaccatacgttattatcaattcctattattttgattattctaccatttctatcgataatagccctatttgttatatctgaatgggttctagaaaaatttggaattgatattgatgaatatatcgctatcaaaccttactagtaatttttacaaaacagagaaacacaatgacaaacatacacaaccacaaaatcttaatccttgactttggttcacaatatacccaactaatcgcacgtcgtgtgcgtgaaatcggggtttactgtgagctttgggcttgggacgtgacggaagaacagatccgtgaatttaacccaacagggattattctttccggcgggcctgaaagtaccaccgaagaaaacagcccacgtgcgcctgaatatgtgtttaacgctggcgtaccagtgcttggtatttgctacggtatgcaaaccatggcgatgcaattaggtggtttaacggaaacttcagatcaccgtgaatttggctatgcatctgttgagttaaaagcaactgacagtttatttgcaaaattaaacgatgatctgaccgcttgtaacccaaaacttgacgtttggatgagccacggcgacaaagtcacacgtttgccgtcaaacttccaaatcacaggtgtaaccccaacttgcccgattgcagcaatgtcggacgaaagtcgccgtttctatggcgtgcaattccacccggaagtgactcacactaaaagcggtctagaattactgaaaaatttcgtggtcggcatttgtggttgcgaaacaaaatggacagcggaaaacatcattgaagatgccgtagctcgcattaaagcccaagttggcgatgatgaagtgattttaggcttatcaggcggtgtggactcttctgttaccgcactacttttacaccgtgcaatcggcaaaaacttgcactgcgtattcgtagataacggcttattacgcttaaacgaaggtgatcaagtgatggagatgttcggcgataaattcggcttgaacatcattcgtgtaaacgctgaagcccgttttttagatgcactcaaaggcattgatgaacctgaagcgaaacgcaaaactatcggtaaagtattcgttgatgtgttcgatgatgaatcgaaaaaactcacttcagtaaaatggttagcacaaggcacgatttacccagatgtaatcgaatccgccgccagcaaaacaggcaaagcacacgtgatcaaatcgcatcacaacgtaggcggcttgccagattatatgaaactcggtttagttgaaccattgcgtgaattgttcaaagatgaagtacgtaaaatcggcttggcattaggcttaccagctgaaatgctcaaccgccatccattccccggtccaggcttaggcgtgcgtgtgttaggtgaaatcaaaaaagaatactgcgatttagtccgccgagctgacgcgatctttatggaagaactacacgcctcaggctggtactacaaagtcagccaagcctttactgtgttcctaccagtcaaatcagtaggcgtaatgggcgatggacgtaaatatgattgggctgtttccctgcgtgcagtcgaaactatcgactttatgactgcacattgggcgcatttaccttatgatctattaggtaaaatctcaaatcgtattatcaacgaagtgaacgggatttctcgcgtggtgtatgatgttagcggaaaacccccagctacgatagagtgggaataatatcccacctattcacagcttttcatagtatttcaattttttttgcgtaaaaattgtcggtaaggattgagctgtttatcccttaatatcaaaataccgtcattaatttgacggtattttaaaataggggggaagaatgctgacagatagtaaaattaaatctttaaaagcaaaggataaggcttataaagtagcagatcgtgatggattgtacgttgttgtatctcctgctggcacggttacgtttaggtatgattatcgtattaacggacgaagagaaacattaacaataggaaaatatggaaaggacggcatatctcttgttgaagcaagagaaaagctaatgatggctcgtaaaatggtgagtgatgggatttctccagccacagaaaaacggaagaagaaaaatcaaataaaaagtgcgaataattttgaagcgtttgcacttaaatatattgccgaaactgattttgcggaaagtacaagagcattaagacttgcgacttacgaaagggaaattaagaagtattttggatataaattaatgactgaaatttccacagaggaaattagagggcattgtcaaattattggggataacttataacgaccctatcccaaattctgtgtaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagccttatactataaggctttgagccagtttttagcgactatgttgtctattacacctttctagagttatgttcagttttcattttttccaagagctgttcacttttcctgagtgtttgttcaatatttctaagttttttatcgtattcttcaaacattctatccatttcatcaaaatcaaacttttgaagtgccttgaatgtttcccatttttcttcttccgtcatacgagcaacgacttctttaacaagttgttcttcaaagttcattttcttatccttacatttggtaaaatgggtatattaaatactaactatgcacttatgaaaattcagtagcaaatttattagctatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtagcaaatttattagctatctgtctaatttcattcatttctcttttattagatagttgaataatattagatttacatatacgcaaggttcctctaattatttcatccttgttatacttggtttttcctattgtataaatgaaatcataataagaattgatactcttggaatatatagataaaacagatatatacacctgagtatttaatgtatcctttgaatttataaatgaaataaatcggtcattgtcgagatgttttaatttattccaaagttcaattatgtgattttccatagaatttcctacagaacggctaatagccttggctactcgccctaaaatatcaaaaaaattcatattatttcctatttcttatttggtttaaagtttattgcaaatttctaaattcaatttaacaaactcttcccaactatacagatgagataaatgggctttatagtaatcttccactcggcaaacaagcggtcggttttcatagattttgcacaaattagtttgttcatcaaaatgatggcaaacgccatcaccacgatctaaataagcggtttgttcacttaaattcactcggcgacagcatttgccacaggaattgcaggggaaagaagctaaagaactcatttgactgctaaactagctaaccaatttctagtactttgctcattacctgattcatacggtaattctatatttcggcgatgaatctctttttctaacactatagaacgttctaattcggaattacaagcctcaaggctatctacaaatactgctatttcatttggatttaagttaaattcaatctttgcccattctaataaataacggtcaagctctgcattaatttccttcatatgttctgtcattaattcatacttatttttatatgaattaattatttcccataactttttgaaagataatccattttcaataaaatatgcaaaagcacacgtcataagccctgtggctaaagcacttacaaatgctgctattaaatctcccattggaaaaataagaatagtatttagatgagagtttaacattgtacctaataatgcagataaacctgcactaagtatttttaatacgcctttaaacaattcttttgcattaagattatctggattaaaagtaattagtttaattacacttacaatgctattccacatttcacgaatgagctttaccaccattttttcagaaacaagaaatatattcattactgtagtgctaatgttgctaaaaaagcctgcaattgctccatctttaaatgcagttaaaagatctttaaaacgttcttttacacgttcaaaaatattacttaatgtcttagcaattttttctaaaaactttgtaatcgtaaagttttgttttagattttgataaatctcaggtattctctctcttaactcaaaccaaatttctgcaagaactaaacctaatgcctgacgtgttcccatttttaaaccagctttacctgctgcaagtgctgttgatttgaaaaatttggaacttgtataatatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacttgtataatatttataattaattttattattatatttatctctagcatctttttctattttacgacattgctcctcatcaagattttctaaaatttctttttttctttctaggattcttagctctttttcttttttagctcgttcttcttgagatagattactattattcagttcagatttcttttgggtaatctcttgtgccattttctcaactctttgatctctaacgccacctttttcaagaaaggttttaaagttatgatcatttttttcattatttataatccagtgtgtagaaactaaattatcttcgctatttgcaagctctacgccatctaatccagatagtattcgacctaaatcatcgtgtatttcacttgcagcgacaacatgatctaattctgtaacatactcaaattctttcccatttcgttccttcttgatatcatctgcattgattttctctccagtataaccatcaaccatggttcctaaatcttcttgttctttatctttagcttttcgttttgtatataatgtactttttccatgataatcatcttctttttttacttttcctttaccatctttttgaacatttccctgttgatcgtatttaactttcttataaggatctatatttcttccattagaatctaattgactagcaagttcatttgaaacatggattgttgaactccccttttgtttaatttctttttgatattctcgtgctttaagaacagtatcaacatctccaccacgcttatcttcaaaaagcaagaaatctaaaccaaaagtagtgactaatgaatttactaccgttttttctaattcacctgtccaatcaaattcaggcttagtcataagtacatttgacatatttcactccctataaaaaggcgagattcctctcgcctagcataatttactcaaaatcttttgatttatatgttgataacgtaatatgcgcatcaatatcttctttattaatgactttcataccatctttatctgtttcaaattcaacagtatcttctttgtttttaactaactctccattatcatcttttttaggtttaaataatggggtagtaataatatctgttaaaatagctgctactttataaccattatcaacaatcttaataattgctgatgagatggtattgatatcaactccattacgaactaaggtatccatatttttaagatcttggaaatattgaccaaaaatctgataaacacgattaagttctttatagatcttatttgaatattcctcagtttcttttaaatgatggcgaccaagtttcatactactaactgcatttttaacttgtgtacgataatctcttgctgattcaagttttttctccgaatgttttgcaaaagctaagccagcaactaatactattggagctacaacaccaccacctaaaattgctgcacctccagccattccaaagccaccagcagaaatagcaccaccaccaattgcagccatggtagctttatatgcggcagctccagaaagggctgcaataggagtgccagttgaagcagcagccaatgccattacaccaccgtaaacagcataagcagcaccagcaccaattgcagcccctccagctagttgccctaaataggcgacagctgaaaaagcaatcccttcaattttatctaattcatttttaggaatattaatttgtaagtctttagcttccttatgttgagctaatttttccaatagcaattcagaaatgcgtttgaattcagcaaagtctgaacctatggacaattgcaattgacctaatgattccaatgatgcattagttgcggcatcttgctcatcaaataactttttttctgtatcataaagactttcggcggcttcagtaatatcttttgcagcggaattatctttaaaaccatcaattccttttttaattcctgttcctatagtcacggcagcagcaccagccaaaataaacggtaaaggcataataaactcctatgcttaatctaacaataatgtaacttctctagataaagcaaattgcttttctacccagctttctagtgcatttaatttttcattagaaatacccagttttcttgcatacccagcaatcatatctttctcacttaaatgatattcttcatttgcgtgagcaacacctaataactcaagtaatagtgaacattttgctctttccgttgtaaataacgtaacaagttcatcaactgtaattgctttttctgttacaccatcttctgattgctttgttagaatctctaccatacctaattgcaattcatctgaagagccatctgctcgtgcaatttcgtgggctaagtaaattaatgcagattgttgctctgctgttaaattttgtacaaacatatttttctcctgttgtttgtgttggtttaattgttgatagaatacttttttctcaaaaatgcaatttggatcacagcaggtactgttacgcgagttgcaggacctgaaatatcttttaatgcccaaattcctgttatcccccaaccaataggacctgtggcaaagcctaaaatacgccctaaggctgtgcctgctaatagtgtaccgatagtttgaggaaacattgtatgaatagtcttccaaagaactggggtagataaaagagaatttaattcaactagaacaagagccgttaaagattgtttacctaaatgagtagctggaatttttaattcttctgctaatttttttaaatcatcttcagatagctcttcgatagcactagttaatactttatccaataaatgtttttcaataagttcggttgaactttctttattgaaatttactttcattttttcacaaacttcaataagaatagttttatatgaaacccctttccctagtctaaataacgtagcaatagtatttgctccgaatttctgaatttcttctgcaatctctttccaataaagattatgatcagggtaaaatactttgtaaactctagagcttgttaagccctccgtataacgttttttaccatctttatccttagttaaaatatctactaagggttgtagatcctcgtttgtacattgagctaaaaactctaaatcaacatcatagacataagccatataaaatttctcctaataattacagtttattccactcccccccaacccttttattcgcaagatctcgatagatttcacagtcggggtttaaggtcagtaatttatatagcaattgttacaaaagatagaaatactttagtgaaaatactaaatcatcgtttctttttttataaaaattgcggaatagatcatttaaatatctatatagtttattttcccttataaaaacatagaggatcctcctgtttatctgcctcttgtttcatttcttctgttggattttttatatatcgaatagcataaccattttctttaatcgcaagcaacttcatttcttctgttggattttcaatatattgaatagcacaaccatccacttttactgcagctagcttcgtttcttctgttggatttttgaaaatattaaaaggccaaccacgttgtataagctctactggtgtcatatcttctatacgctttttatatttaaaaaaagccattaattggttttgattcatcgccaaacttactcatcatatcttattcctttaaaaacattttttacgaagaaaattttttcttccaaaccaccccaacccttttattcgcaagatctcgatagatctcacagtcggggtttaaggtcagtaaattatgtgctgcaattgctgcaagggataaaatgccccaacggggatttaataccgctgataagcctacggctaagcgatttttggtataaaggcgacacttcaaatttaaactttcaatatatttttcaagttcttgactaaaggcgaataaattacctgcatcaatgccacaggtttcaaaactttgacgttcattaattaatgctttaatggttgaaaatggctcgctaatatcaatttttttcatatttccccctaatcattcgcaatatattgtttcaacttctccaccattttttcctgcaagccgttagggctgatgatggttaaatggggaatccaatattgcacaagcggtacgatgtcgagttcgtttacgttttcgctggctaaaataagttcgccgttttccgatttatgcactaatttttgattaggcagtaaatttcgtcgaaggaagtaaggggaggcaaagctggatactttaactaagacttcactgagctgattgccaaaagagatactgtcgttacttttgatctcttcttgtagctgttggtttggttcgaaagtttcatcaagcatcttgagcattgtgatttgagtgaagcagaacgttttctgtttgtcttcatctgtgccgattaaataccaaatgccatttttattgattaggctataaggggcgattttgtaaaatttgccatcaatctgaccgcttttcttatataaaaaatcgataaatttatgtgcttcaatggcttgtttgatcagttgaaattcgttgtctaagtggcgaatgtcttcatattgaaaacctttcactttgacgctgtcggtgagtttttcttgataaaaatcgcgatctacctttgggaaaaggtctgaaatactggcaaataacgcaaaacgagagatgtcttgctgagatagtatacctagtttataacggttgattttgtaatgtcgtggtccgctctcttcccattcgagaaaggctaaacgatctttaatatcacgttgaatggtgcgaacacttaccccaaaatcttctgcaagttgattaatatcaatgcgttttccttgattgagttgggataaaatttcactaagtcgttgtgctagaacagtattcttttgcatacatctaaatcctctgattttgaatgcgtgcagtgtacccgaatggtgacgacaggttgtgtcagctcaacaaaaaaatcagatttttataaaaatttttaaataaatttgctcttttattttatttagacctttgaagtctaatataagtattattcgctatttatcaaaaaaagtcaatgcctattatttctttctttataaagggagaaatcgtgtgttagataaaagtgagcaattaatacaaacgattgggcaagcgattgcgaaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaggcttaacgcaagcgcaattagcggaaattttaggcattagtaatgatgctgtttcaagaatggaacggggcaaaacaattccaactgttttgcgtttgttggaactttcggagatttttcattgtgaagtagctgatttagtgaccgaaagcagtaaccgttcgaccgatcaagcgaaagttatcgaaaaattgttacaacaattagatagtcagcaacgatcagaattgctctatcttattgagcgattagtgaaatggaaaaatgagtcgtaacaggataaaaaataaggtggcaagccaccctattaaatgattacttaaacaccgcccacacaggtgcgtggtcagaaggtttgtccattgctcgaatttctaggtcaatgcctgtttcgacacagcgttcagccaaaggggttgaagcaagtactaaatcaatgcgtaaaccacgattatcatcaaaacctttagagcgatagtcaaaccacgagaacttatcttctgccgttgggttcattgctcggaaagtatcaactaaaccgtatccgtgtaaacgccctagccactctctttcttcgggtagaaatgaacatttaccatcacgcagccagcgtttgcggttcacttcgccaagcccgatgtctaaatctgttgggctgatgttcatatcgcccataatcacaatcggattttcaggcttgagttctgtttctaaataacgttgtaaatccgcataaaatttttctttagcagggaattttgtttcgtgactacggttttcgccttgtgggaaataaccgtttaagacggtaagggttccgaatggggtttcaagatctgccataatcatacgcttttgtgcatctgcgttgtccgttggaaaacctttacgcactgcaagcggttggtttttggttaaaagtgcaacgccataatgccctttttgtccgtgatgaaaaacgtgatagccaaggtgattgactaaatcgtaagggaaatcttcatctgccactttgatttcttgtaagccgatcacatcgggctgatgtttttcaataagcgcttcgagttggtggggtcttgctcgcaagccattgatattaaaagagatgaatttcatattgtcctttaaatctctctaaatgcctctttttcaaaggggatttaatgagagaaaatgaatttcctataaaatcattgctgcaatccaaccaaacactaataacgggatattgtagtggataaaggttggaacaacggaatcccaaatgtggtcgtgtttgccatcagcattcaagcctgatgttggtcctaaggttgagtcagacgctggtgaacctgcatcaccaacgtgagaaaccgaatgaaagacacaatggtacatagatagaggtaataattggtactgttgagaatgaagaaccgatccccatggtaattaataagccaacgaagagcattaagaatgcagccatacctttgcttccgatcgagtcttttaagccttcaactaattcagccacgccacctgttgagtttacaacacttgcatagcctgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgcaatcattacaaagccgatcatcgccattaaacgtaagccatcttggaaaatatcgttgctttgtttaagtttgaacacaccgccaacggcaaagataatcaaaccgactaagccacctaataccgttgagtttgttgataactgaacaaaacaggtagcaacaattgctgcgatactcacgccgatgtggaatgatttcacatttgctacacgagcttcaatatcatcagcggttggttctgggcgatcttccacataaacacgtggtttgcggtaggttacaaagaacgctaataataaacccacgatcatacccgccacaggaattgccattgcttgagtaacttctgcagtgttggtcactaggttaaatggttgccctgcttggttgatattttttaccaagatattttcgataaagatttgaccgaaacctgctggaattaacatataagttgccgttaaaccaaaggttaatgcacaagcgactgcacgacggtcaattttaagttggttcattacgctaagtaatggtggaacaacgattgggataaacgcaatgtgaactggaataacgttttgtgatgccattgcgaaggcaactaacgtaaagagtaccgcatatttaaaccaaaacagtgaacgaccagatggacgtttgccaaaggctttaatgattttatatgccagtaaatcggtaacacctgattttgataaagcgacggcaaaagcacctaatactgcatagttcattgcagtttcagcaccaccgcctaaaccaccagtgaaactttttacggttgtcgttaaagcctcacctaatgccattccgttgccagaattacctaaaataccgcaagttaaggcggcaataatcaacgcaattacaacgttaattcgcaataaacttaatgcgagtaacacgataatcgagatgaccacatcgtttgataataacattgtgttttcctcttaatgtaataaaaaaataaacctattattcaattctacgagataaaaaagaaccccttcgaaatcatcttccgaaggggtggaaattggtttttagatctactctcattttgcaccgctcggaagtttcttccgaacacgccaaatgcccgaaagattattcaggtaaatggtgatgacggtgacgaatgtttgagagaatgttcatagtagctccaaaattgaatgtgccgaaatatatcctagaaaaaaatgaaaagcaaacgtttatttcgctttttgcagattttttcgactaactcaccgctttaatctgaattaaaccgctttccgcataatctgctgcatcatctttatcttgaaccacaggagcagacggaatttctgctttatcaaaggcaatatctccttcaacaccgtcaattagctgaccacgtttaatgcctttaaaatcaaagagatttggatcgcatagatgtgatggagccacattctgcaaggcactaaacatcgtttcaatacgtcctggatattgacgatcccaagtctgcaacatctctttcaccacttgtcgctgtaagttaggctgggaaccacataagttacacggaatgatcgggaactgttttgccacggcatatttttcaatgtctttctctttgcagtacgcaagcggtcggatcacgatctgtttaccatcatcgctaattagctttggtggcatagatttgagctttccaccgtaaaacatatttaaaaaaagtgtttcaagcatatcatcacgatgatgtcctaacgcgattttggttgcacctagttctgtggcagtacgatataaaatcccacggcgcaggcgagaacagagcgagcaagttgttttcccttcaggaattttctctttcacaatgccgtaggtgttttcttcgacaattttatactctacgccgatactctcaagatactcaggtaaaacgtgttctgggaagcctggctgtttttgatctaaattcaccgccacaatatcaaaatgaataggggcgttgagccttaaattgagcagaatatccagcaaagtatagctatctttcccacccgataaacaaaccattactttgtcgccatcttcaatcatattaaaatccgcaatcgcattgcctacatttcggcgtaagcgtttttgcaatttattgaagttataggcaatttttttctctttttgcgtgtcttgaacagcgtcttggtgcataatttaacaaattcggattaaacaaaataaagtggcacatagtaaccagtttgctatttttttcaagtatttctgaagtaggtcgggcatttatgcccgacaattattacaatccataaaatcaacataaaaccaattacataaacgtcgggcataaatgcccaacctacaaggaaaaatatgttaaataaacgcattattatcggcattagcggtgcaagtggctttcagtatggctacaaagctcttgaactgcttaaaccgctagacaatatcgaaacccatttggtgatttcaaaaggggcggaactcactcgccaatatgaaaccaacatcagcgaagaacagctactatcccttgccgatgtggttcaccctatccacaatttaggcgcttctatttcaagcggttcatttaagactattggaatgcttatcgtcccttgctcaatgcgaaccctagcgtcagtcgctcacggttttagcgataatttattggctcgtgccgccgatgtagtgttaaaagaacgacgtaaattggtgttaatggtgagagaaacgccgttgcacttaacccatttggataatatgcgtaaagtcaccgaaatggggggcattatttttccgcccgtgccagcactttatcatcagcctaaaacggtcgatgaaattgtgacccatagcgtcgctcgtgcgttagatatgtttgatcttgagattgatattccacgctggacaggaaagtagatgaataatccaattcctacacacattgtgcaatttatcttgaaaaatcacgtggtgagccttgcttgccaccatcagcatcagctttggtcagccagttgcttttacgcttttgatgaagcatctcaccgcttgatcgtgctgtcaaagcaaactaccgaacacggcaaattgatgttagccaaccccaacattacaggcactattgcagggcaacccgacaacattcgagagattgaaggcattcaatttcaagccgttgctcgttgtcttgagaatgaacaagaaaaacaaactgctttacaaatttattggcaaaagcatccacttgcaaaattgatgagtagcgatgtgtgggaaattagctttacccgaattaaacatacggaaaatagagtggcgtttgcgaaaaagagtgattggaaaaagctcttttaacaatgaaagcatgtgaattaaaaaataatgaagaataaatgtatgtcttaactttaatatatttgggataaggtttatgtatttcacttttatgatatctttgttactagcctgttttccccgtacaataaccccaaaccacccaactttgagatcctcttatgtttaattctctttttgctcaagctgaaatgaaattgaatacgttaatgacgttacatcaaattcccgaacatctgcaacatcccccccaaatcccaccgcttatcaaagctattgcaatgtcggatttcgtggctcaacagttgcaaaaacaacctgaattattgaccgcttggctggaaaaatcgcctgaaattcaggatggtgaacgttatgcagagcggttgcaagcggtgatttctacggtgaaaaatgaagaagaattacagcgtgagctacgccgttttcgtcatcgtgaaatggcaactttgagttttattcaatctaatcagcgagcttcgacccagcaggtgtttgagcggttgtcggatttagctgaagccttgattttgggggcgagggattggctgtttgagcagatgtgtggcgaatatggcacgccgatgaatgagcttggggaaaagcaagagttgctgattttgggtatgggtaaactgggggggcgagagctgaatttttcgtcggatatcgatctgatttttacctatcctgatgttggggaaacggtaggcggtaggaagccgatggaaaacagtaagtttttcactcgtttaggacagcggttgatccgagtgttagacgaaattacccttgatggctttgtttatcggacagatatgcgactgcgtccttttggggatagcggtgctttggtgctgagttttacggcgatggaggattattatcaagagcaggggcgtgattgggaacgctatgcgatgattaaggcgaaaattttaggcgaagatctgacgaacattaaccataagtatttgaagcagatgttgcgtccttttgtctatcgtcgttatttggattttagtgcgatccagtcgttgcgagagatgaagcagaaaattagtcgtgaggtgttacggcgagggctggtagataacattaagctgggggctggtggtattcgtgaggtggaatttattgtgcaaacctttcagatgatgcgaggggggcgagataaaattttacagcaacgaagtttgttggcagtgttgccaccgttggctcagttgaatttgttgagcgaaacacaggtaaataatttgcgtgaggcgtatctatttttgcgacacacagaaaatgtgttgcaggcaattaatgatcaacagacacaaaccttgccgacaaatgaagtggatcgggcaaggttggcggttgcaaatggggcaatggattgggaaagctttttattgcaactacatcaacaccagcagaatgttcgagcgatttttaatgaattgattggtgaggacggcagtgaggaaagcggtgaggaaaacccaaaatttgccgaatggcgagatattttaaatgtacaacttacccaagaggatttagctactgttcttgcgacctatcctgtagcaactcaagctcatagggagatctaccaacagcttataaccactctacaagagtgggtgaaacgcccgattggagtgagagggcgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgctacagaagctgatgccgaaagtgttggatcagatttttcacgaggcggattatttactgttattgccacgcattttgaagatcgtagataaaatcaccttgcgtaccacttaccttgaattgttgttagaaaaagagcagattttgcctcaactattgcaactgtgtgggcaatcaataatgttagcagagcaaattgcacgttatccgatgttgcttgatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttttcagcaaagtttaatgacgatcttaccgcttgaggcttatcctcaagccttgcgagagtatttgttgcgtatcccagaggacgacgaagaagcattgattgacgggttacgccagtttaaacagagccatttattgcgtattgcaggggcagatattttgggggtattgcccgtaatgaaaatcagcgatcacctaacctatctggcagaagctattatcggggaagtggtgaatttagcgtggcgacaagtggcacagcggtttggtgagcctcaacatttacaaaacggcgagaaagattttgtggtgattgcttatggcaagttagggggaattgagcttggctataattcagatttggatctggtgtttttacacaatgcccctgaacagagcgaaacagttggcggaaaaaaatccatttcgagccatcagttttatcttaagttagcccaaaaaattaatggtatttttaacttgaataccagtgctggcgtgctttatgaagtggatatgcgactgcgaccctctggagaagctgggttgttggtgagtacatttaatgcttacaaccactatcagaaacacgaggcgtggacgtgggaaagtcaagcccttgtgcgaactcgtgcagtatatggcactgcggaacttcgacaaaaatttgagcaaattcggcgagaaacgttaagccaagagcgttcaagcggtcagttacgagaagatattcgcaatatgcgagaaaaaatgtaccaccatctgagcaaaactaccgcagggcagttttatttaaaaaccgatcaaggtgggatcacggatattgaatttattgctcagtatcttgtgttaaactatacccatcaatatccacaaatggcggattggtcggacaatgttcgtatttttgaacgagcggtggattgtggtattttgactgcagatgaaggtgaacgattgaaagggtgttatactggtttacgcgatcaaattcatcgtttaaatttattgaataaagagagtattgttgatgccagcgaatttattgatgaacgtcagtatgtagcaacttgttggcaacgatttttgatgtaagagtgagggatttaaaatgaattacaataatgaatgtctttccatgttaaaactaggaaaaaaaacagagtataaaagtacttatgatcctagtttgttacaagcggtacctcgttatttaaatagagagagtttaggtattgttaaacagcaaccttttacggtaggagcagatatttggactctctatgaactttcatggcttaatcaaaatggagtgccccaagtagcaattgcagatgttattattgatagtagtagttcaaatataattgagtcaaaaagttttaaactttatttgaatagttttaatcaaatgcgttttccttcaagagaagatgtacaaagacgtattcagtctgatttaagtaaatgtgcccaaggagatgtcacagtgcaaatttataaattatctgattttgctatgcgatcaatttctgagtttaatggagaatgtatagataatcaaaacatctgtattaatcgttatgattttacaagagagtccttacaaggtattgcaaatggggaaattgtagaagagagattagtaagtcatttattgaaatctaattgtttgattacttctcaaccagattggggaagtattcaaatttgttatgtagggaagcaattagatagagagaaactgctgcgttatttagtttcgttcagagaacataacgaatttcatgagcaatgtgttgaacgaattttttgtgatttaatggaatttgctcagcctcaaaagttgactgtatatgctcgttatacgcgtcgtggagggctagatattaatccttttcgctcaaattttgaaggaataccagaaaatttaagaatggtgagacaataatgtatgtagatgatgattgctgtaattattgttttttgcaaatagccttagtccctctaaaaagaagtgatagaatggagtttttagaacaatccgctagaaaggtcttcaaatggaaaataaaaaactaacaaaagccttagacgctattgatttaaaaatcctaaatgaattacaacgtaatggtaaaatttcaaacattgaactctctaaacgtgttgggctttcgccaacgccttgtttggagcgtgtgaaacgtttagaaaaacagaatgtcataatggggtatcgtgctttacttaatccagaattattagaagcccctttgctcgtgattgtagaaattactcttgttcgtggtaaacctgatgtctttgaggaatttaatcgggcggtgcagcaacttgatgaaattcaagagtgtcatttagtgtcaggggattttgactatttgctcaaaacccgtgtggctgatatggcggcgtatcgtaaattattgggaacgacgttgttgcgtttaccgggggtgaacgacactcgtacctatgtggtgatggaagaagtgaagcaaactaactatctacttttgaaataaggattagctgtgattgatcgtttaaaagggaaagagaacctgattagattagtgttgttgctttcggcgtgttttgggatttatctgatcacggcgtgggcgagttatagtccgttggataatgcttggagtacggcaagttctattacccacgaaacattaaataaaacaggggcattgggggcgtatttagttgatttgctctttgcgatgtttggtaaagttgcggtatttgttccttttgggctggcatttacgtcgatttatgtattgattttacggttagctgacgatctaaactgggcgaaaattgggttttggctagggagctttttcttatttttagtcgggctggcggggttgtcgagcgtattgtttgaaaattccccttactatctttcgggtggttttattgggggaatgttagcgtcttggctcaattctcaaatggtattgttgctcgttgcaatgctattaacggcggtaggtttctatttttgttcgggacagattttgttgcaattatttaaccgcttgtatcattggatcgtggaaggaaaaaccgaagataagccgagtacgttaaatactgacgaggctgttcaaacagaggaaaatgaggagaaagtcgaagcggagagtgaaagcgaagaaaccgtagataacccacaatacacagatgtttctcagtttactcgtccgcatattacgggcttgaaaaccgttcaagaggaagaagtcgcagctgacgttgaattaaccgatgtaacaaaatttaaagtggagaacccaagttcgttgccaaacattagggtgccggagcttgatgttgcagttccttctgtatcaacttcctttgagtcgccggaagaaacagtgattatgccaaacgttactgagccggtaatgccaaaggtgcgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccaaaggtgcgtttaaaccctgtggtggaagtggcggcagagcctacagtagagccgtttgaagaagcacaatcaactgtgcaatttttacaagaaaacctaccgctatttgaacctaaagcagcaacagcagaggcacaacctgaaaagaagggtgtaacttatccgaaaggttatggcgatagccttattcacccgttgttacaaactaagagaaaggtcgaaaagccaaccacgccgttgccaacgattgatttattgacgacagtaaaatcagaagaacagcaaattacggagcaagaaattcgagatacctcagctcgaattgagcgtgaattagcgaactttggggtgagggcaacggtggaagatgtgttggtaggccctgtggtgacacgctatgaaatcaaaccggcagcaggcgtgaaagcggcgaagattaccaatttagcttcagatcttgcacgttcgctgatttttgaagccattcgtattacagatgttgtccccggcaaaccttatatgggaattgaaacccctaaccgtcagcgtgaaacagtttggttgcgtgatgtgctggatagcaatgagtttcgccataccaaagcgacattgccgatggcattaggaaaagacatcagcggcaagccgattgtggtcgatatggcaaaaatgccgcatttactggtcgcagggcagacggggggcggaaaatcggtcggagtaaacacgatgattttaagcctattgttcaagctatcgcctgagcaggttcgcttcattatgatcgacccgaaagtagttgaactgtcgatttacaacgatattccgcatttgctgaccccggtggtgacggatatgaaaaaagccgaaaatgcgttgcgttgggcggtggaggagatggagcgccgttacctactggtgagtagtttaaatgtccgaaacattgaggggtttaatgcgaaaatcgatcaagcggcagcaatggatctgcctattccaaatccgttgtggcgacctggcgatacaatggatagtttgccaccaccgttagaaaaattaagctacattgtgttgattgtcgatgagtttgcggatctaatgatgtcggcaggtaaacaggtggaagatcacattatgcggatcgcccaaaaagcacgagcggtcggtattcacttaattttagcgacacaacgtccatcaactgatgtgattactggggtgatcaaagcaaatatcccaagccgtattgcatttacggtggcaagccaaattgactctcgaaccattttagataaaggcggagcagaatctctattagggcgaggggatatgctatattctggggcaggtagccctgaaatgatccgtgttcacggggcatttatgaccgatgaagatgttcagcgtgtggcggataactggcgagcgagaggtaaaccagaatatattgaaagcattgtggcaacaccagagggtgatgaaaatggcgaaaactcagaacgcacaagcggtgagttagatccactgtttgacgaaattgctcaatttatgattgacggtggggcaacctcaattagtggcgtacaacgtcgcttctcactaggctttaaccgtgcagcgagaattattgatcaactagaagaacaggggattatttctgctccagatagtcgaggcaagcgagaagtgctggcgagataaaggtgtttggagtatttgacaaacctatggcattcttttactttagaaagaataacaattatataacataaggatttatagcaatgagcaataaagtgggcaacacaatgtataaaaatgatgatgttcgtattaaccatattgaagaactgttaccaccagtggcactattagagcgttttcccgcaagtgatgttgcagcggaaacagtcgcgaccgctcgtgaagcagttcatcgtattttacacggagcagatgaccgcttgttagtggtgatcgggccttgttctattcacgacccgaaagccgcattagcatatgcgaaaaaaattcaagaaatgcgtgcaaatccgtatattaatcaacatcttgaagtaattatgcgcgtctattttgaaaaaccacgcaccactgtgggttggaaagggcttattaacgatccttacctaaacgaaacttttgcactaaacgacggcttgcgtattgctcgcaaagtgttatcggatattaatgatttaaccgtaccagctgcaggggaatttttagatatgatcaccccgcaatatgttgcagactttatgagctggggagcgattggtgcaagaacaaccgaatcacaagttcaccgtgaacttgcatctggcttatcttgtgctgtaggctttaaaaatggaacaaatggtggcgtgaagattgccttagatgcgatcggcgcagcagaagcccctcaccactttttatccgtaactaagttcgggcattccgcgattgtttcaacagcgggtaatccagattgtcacattattttgcgtggcggtgataatggcacaaattatgatgcggactctattgcaaaagtgtgtgtggatatcgaaaaatctggtcgccgtccgcacgttatgattgatttcagccacgcaaatagccaaaaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaatgatgtggcacaacaaattgcgaacggctcacaccttatttcaggggtaatgatcgaaagtcaccttgttgaaggtcgccaagatttagttgaaggtaaagaattggtttacggacagagtattaccgatggctgtattggctgggaggacagtgaaaaagtgctattccaacttgctgatgcggtagcaaaacgccgtcaattaggcaaataattggtattatgtcgtctcgcttttttcaagcgagttcaacattattttctttatatgacattatgaacaaaactattttagcactagatactgccactgaagcctgctcagtggctttgttacatcaaggtaaaaccacatttattgatgaattaagtccaagaacccatactcaacgcattctgccgatggtagatgaattgctgacacaagcggggatttctgtgcaacagattgatgttctcgctttcggaagaggccctgggagttttacgggtgtgcgtgttggcgttgggatcgctcaggggttagctcttggtgctgagttgcctgttgtgcctgtgtctaacttactaacaatggcggaagaggcttatcaaaccttgaatgccaacagtgtgattgcattaatagatgctcgaatgaatgaagtctattttgcacaatttgaacgaacagagcagggttggcaaactcaggttgcagaacaggtctgttcaccagaaaaagcaattgcccaaatgcaactcattgaaaatactgtggttgtaggaacgggctgggcagcctatccacaatttgagcaggctaacctcgctgtcaaagtaacggagattaccttaccatcagcaaaatatatgttatctttggcaattgagaaggttgtacaaggaaaagtacagtcggcgtttgatattgaacctgtttatttgagaaatgaagtgacttggcaaaagttgccgcataagttgtaggtatattatgttgaaaattgcgaataaatttatttcttcttctatttcaatggctttttggggggtaactgggtggtcggttgcttatgcctatggttgggggcagtcatacttttatggtttcccttggtggtatgttgatgtgggaattagtaatgttgctagaagtttaggatatgtgctttggaatacggctattttatttcttacttatttaattggattatatattctaataaaagctaagaaatatatgccggaaccgtatattcaatttttacgagcatatattttgatttgcatagggctaagtcctcttctatttggctatattgcttcaataggaagatgtaacacttatgtcggattaggttatttattattgatattattatttactttaatatttaagaactatataaatcataatattccaagtatttctgttaaagcaactatgcaatttttatataaaaatcaggtgtatataattatctgtacatattgctgttttgtaatgtttgcttttataacgggttatattcgtcctaattttaaaaatacttttgatataatagatattgatcataaaacctattatatattggcaaaatatagcgatacttttattttagctaatgagatacatgcaaataatgataatttttatatttataaattatcacctaattcgttatttcatataaaagtagtgaaggtatctacatctaaataatgtacttgtacatcaaagaataggggcagtaaatttaaaatgttgatggactaattttacaaaggcatagtagacaagtttgttgctaatgtttgttttctttaaacattagcaaccctttttatttggcatagtagacaaaatggttgctaatttcgtgaaaactatgccttttatttaaaaaaatcttgtataaacaacatcttacatcatttggaatggaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatgaatattttgaatcaaacttagtgaatctgctcctccagatgaaagagcatgaatactaaagaaagcatcattatcaatacgaatgcctatggctggacgagaagttaatacactggaactggaattaatcacgaacacttcgcttgccatacgacgagcaataatcgcaagattaactcgatttgccccgacatctaagcgagagtaatagatataaacattatttggacgacttcttgtccctaagttccacacatattcatcaattggaaagccaaccccctcgggctgaaccattcggcgtgtatgaacggcggtagatggcaatgagccagcttcttgaaccattaaaatacctgccgcttgaggccccgtcaaaagctgacgaacattgatgttccatttactttcattaatcgcagaagaaccttgcaagttccacgttgcaaccgtatagttttccaaatttgccaagacaatttgaggaagtaaacaacatactaatgctatagctcgattaaataacgtcatttttcctcctataatggattagcactaagtaatggtggtgtgagatagaacgtttgatcgtgtaacggtgtaatacgtttatcatcacaacgatccaaagtcagcgtaaaatagccagtggtactcaccgcattgtaagttaagcaacgctgctgggaaacacttttaatgaacaccgatcctgtcgaggttggcagtaactcaaaatcttgatctaaattatttggatcacagctatcttgaatcacaccatttccataagcctgcatacaagatcccatctgctgattagtaaagcggaaatgttcttgacggaagctccgctcaattcgccaattacgcaatttgccaaaatcttgagaattaagcggcggatacatccaaagccagctacgacgatcaacagaccacatcgtaatcaccgccccattttgtcccataatgctgataaagtcgttaaattcggcagtatttgatggactggttgctaacaaattgaccgttggtggaccaggcagttttaacagacttgttggtaaagggggcgtagggtttagcgtttcctcaaacaacgcttgatcatcctttttctcttcctgtggtttttgcgttttttcacaactacaactgcaaccaagtaaagcacttgtaaaaatagcaagtgaagttagatatgtgagctttctcatttatatctccttgtgataatttgagaaaatctatagtcaatgtttactttgatcaagaaaatttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcttggcggatttctgccattaaacgttggtaataacgtaaattgtgaatggtgtttaatcttgcccctaaaatttcaccgcatttatcaaggtgatataggtaggctttggtgtagtttttacaggtgtagcaatcacattcaggatcaagcggtgagatgtcattgcgatatttcgcattgcggattttgacaataccgttggtgacgaataagtgtccgttgcgagcgttgcgagttggcattacacagtcgaacatatcgatcccacggcgaacaccttccaccaaatcttcaggtttgcctacgcccattaagtagcgtggtttatccgcagggatttgtgggcaaacatattctaaaatgcggtgcatatcttctttcggttcgccaacggctaaaccgcccaccgcatagccatcaaagccgatttcaaccagtttttctacggaaactttacgcaattcttcataaacgcccccttgaataatgccgaataacgcatttgggttttgtaattcgtcaaagcgatcacgactgcgttttgcccaacgtagcgacatttccattgactgttttgcatagtcaaaggtcgctgggtatggagtacattcgtcgaaaatcatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacattcgtcgaaaatcatcacaatatccgagccgagatcgtactgaatttccatagatttttctggggataaaaagactttttcaccactaattgggttttggaaataaacgccttcttctttgattttgcgtaatttgcctaaactaaagacttggaaaccgccagagtccgtaagaattggaccgtgccattgcataaaatcgtgtaaatcgccgtgctgacgcataatctcttgccctgggcgtagccatagatggaaagtgttgccaagcagaatttgcgcgcctgtttgcgccacttcttcaggggtcattcctttaaccgtgccgtaagtcccaacgggcataaatgcaggggtttcaacgtgatattcgccctttggacgagaaaaagttaatcgaccacgacgagcgttgccgtttgttttttttagttcgtatttcatttttgttcctcaaataaacagtctgagtagaaaagaataagacgaatagatattcgccctacaaaataatttagtagggattaaatgtctaaatttgcatataaggcattattttcgataaaatcacgacgtggttctacttcatcacccattaatgttgtaaagagtttatctgctgcaattgcatcagtaatagtaacttgtaacatcttacgtgctacaggatccatcgttgtttcccaaagctgctcagggttcatttcacctaagcctttataacgttgaatggttaaacctttacgagattctttaaccaaccaatcaatggcttcggcaacactttctattgattgctggcgttcaccacgttgtacatacgctgtaggttcaaggagatcgcttacttgttcgcctaatttagtaatacgagtatattcattacttgtaataaaattgaaatccaaacagtaagttgtgctaattccgtgtgtagtaacaattacttgaggttcataaatatggcgttctgcattataaaatacctctgcaacataagtacttccactagtttctttagctgttaagatctcaacaattttgttattccaagcggtcacttcagtttcattttttacaaattctgtcgtgagggctggctgataaattaattcattcagtaaagcagttggataacgacgggctaaacgctcaaacaatttttgaacatcattatattcagcaattaatttctcaagtgctaagccatttaatgctggcgctttatcacttacgtaaagtgaagcaccatctaaggctaatgctaattcatattgctccatttccgtattatcttgaatatatttctcttgcttaccttttttcactttataaagtggtggctgtgcaatatagacataaccacgttcaattaattctggcatttgacgatagaagaaagtcaaaagcaaggtacggatgtgtgcaccatcgacgtccgcatcggtcataataataattttatgataacgcaatttctcaatgttatattcatcacgaccaatacctgcacctaatgcagtaattaacgtcgcaacttcttgtgaagaaagcattttgtcaaaacgtgccttttctacgtttaggatttttccttttaacggtaaaatcgcttggtttttacgatcacgcccttgttttgcggaaccacctgcagaatctccctcaactaagtaaagttcagataatgcaggatctttctcttggcagtctgctaatttacctggtaacccccctaaatccaatgcgcctttacgacgagtcatttcacgagctttacgtgctgcttcacgggcacgggctgcatcaatgattttagtcacaatattttgagcatcatttggattttctaatagatattcctgtagtgcttcattcattgagctttccaatggatttctaacttcagaagaaactaatttatcttttgtttgagaagagaattttggatctggtactttcactgaaataacagcgactaaaccttcacgtgcatcatcacctgacgcatcaattttggcatcttctttttttagttttgcccctgtttccatatagtttttcaaggcacgggttaatgcaccacggaaacctgctaagtgcgtaccgccatcacgctgtggaatattattggtgaaacaatatacattttcgttaaaactatcattccattgcattgaaatttcaatgcctatatcatctttttctgttgaaagataaaatggcgttgggtgaattacgtttttaccttcattcaaatattcaacataagcacggataccaccctcatatttgaaatgttcttccttatcattacgttcatcaactaagcgaatcgatacacctgaatttaagaatgaaagttcacgtaagcgtttagataaaatcgcatattcaaattccgttttatttttgaaaatatcataactcggccagaaacggacggttgttcctgtcttttctgtttcgccaattactgctaaaggtgcatcaggatctcctaaactataaaattgttcgtgaacgtgaccttcacgacgaatagtcagttgaagtttggacgagagggcatttaccactgacaccccaaccccgtgcaagccgcctgacactttgtaagaattatcatcaaacttaccgcctgcgtgtaatacggtcataataacttccgccgcagacactccttcttcagggtgaatccccacaggaatacctcgcccatcatcttgcacagacactgaattgtccgaatgaatagtcacgacaatatcattacagtaaccagctaaagcctcatcgattgcattgtccacaacttcaaaaaccatatggtgtaaacctgtgccgtcatcagtatctccgatatacatacctggacgcttacgtacagcatcaagaccacgtaatactttaatgctagaagaatcatagctatttggttgattttgttctgacattgttgttcctatattaacttaaatcgacaacggcaaaatctgccgaaaattaggcaggattatatcagaaaagggaaaaagggggaaggaatcaaacgtactcaataggatttagccaaatcattaccacagtaggtcgcattatttttcagatagtaacacatttttatgattgaggcttaatttaggattatttactatatataatatccagtacatgtgatgatgtaatacttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtacatgtgatgatgtaatacttacacaaaaggataactatatgtacattttaactcctcaagaatttgtcacttgggatgaaccgattgaaatgctttatgcttgccacggaaaggtcaaaagtttctgccgtcagttacaactgttgccagattacttagcgaaaaacggggtaaatcaagcggtcaaaaatgatgtacagcagatcttaaattacttcaatcaatctgcacccttacaccacgatgacgaagaaaaagatttcttcccagcattgattaagcaacgcccagaagcgcaaacggacgtagatttgctcgaagcacaacacattgaattacatcaaaattgggacgaactctccgcccaattagtcgccttactcaatggcgaaattcaacacattgaccgcgagttaatccaacgctttgtggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagttaatccaacgctttgtggtaggttacgatcaacatattgcgattgaagaaccgctttttgaattagggcgagagcatctaagccaagaagaactcaactcaatcgggcagattatggcagagcgccgtcgggtttaatggtgaattattcacttgatctcaccgcttaccgttgccctcttcctcttttgtcggcaaagaggggaatgttacagttgaatagcggagaaagtttgaaacttcattttaataaagacgttttattaaacgatattattttattatgccaagaaattcagtgcgagctcaaaagcaaaatagagtcagaaacagaagttattttattcatctataaagataaggcatagtagtaatactataccttattgtttatttaactgttgctaccatcatcaccatcataaaactgacgacagcaagaatgaaatgtttgagagaaaaaggttgctctttcttgaaggcttttgtcgcataataaatatacatcaccaaaaagaataacttcgctaaaatccacgtttgaaaatccatggcgaaatagacaaaaatgcccacaccagacagtaataacaagctatcaacagcgtgtggtgcaatttttaagagtttatattgtcgccaatcaaccattcttgcggaaagtaatccgcgaaccagtaatagcattaagcttaggtaagctaaaccaatatgagtataaaagatcgtttgcattaattttgtccttatttaattttgttcaataattgtagattttaaatattgaaaaatttcacgataatttttcggtggtttatttgcttgcttctctttctgtgcggcacggattaaattgcgtaaatgctgacgatccaatgtcggatattcatctacaagcggattgatcgcactgtcgccttgctcaatgagttcatctcgaattaactctaatttgtgcaatagggcttgttgctgattatggcgattttcaactttatccaatgcttcctgaataggttcgtgatcgacattgcgtagcaattttccgatatattgaatttgacggcgacgagcttctaaacgtaagcgttgcgctaactcaattgcttcacgcaaggtatcatcaataggcattttagcaagattagcactattcagttctatcaaacttgcccctaattttttaagatgttccgcatcacgtttaatttcacttttacttacccagatgatctcttcttcctcatctgtccaatcaatctcattacgttgttttctagccattgctattcctttcttttacaaaatttgcgtagtttagcagaaatttagggtagaatggcgagattaagtgaaaagagaacagttttacaaaaattttcgctaatcctaccgcttatagaaggaaaattatgtcatttattaccaaacaagaacttcaagctcaagaacaaaccttacgtcaagccgttgaaattgcactggatttagcccaaaaagcaggtgcaacggcagaagtgggcgtaaccaaagtcgcaggcttatcagtttctacacgcttagaacaaacagaaaatattgaatttaacaacgatggctcactcggtatttctgtctatctcggtaaacgaaaaggcaatgcttcaacttccgatttgcaaccaaaatctattcaacaagcggttgaatcggcacttgcaattgcaaaatatacctcagaggacgactgtgcaggtttagctgacaaagaaatgatggcataccaagcccccgatttggcgttatatcatcaagcagacattaccgttgatcaagcggttgaactggctattgaagcggaacattatgcactacacagcgatgatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattgtcaatagcgaaggggcaaccttcaattcacacgcaggtattagagtttatggcaacacacacggtatgctacaaagctacctatctagccgatattccctctcttgtagtgtcatttcagcctatgaagatcagttagagcgagattacgaatacactatctctcgtcaatttgaccaacttgcttcgccaaaatgggttgggcaacaagctgcagtcaaagctgttgatcgtctaaaccctcaaaaactggcaacctgtgaagttcctgtgattttttataacgacattgccacggggcttatcggacacctcgcaggtgcaattagtggtggagctttatgccgcaaagccagtttcttgcaagacaaattaggtgaacagattttaccgacttggtttgaaattaacgaaaaaccgcatttacttcgccaacttgcttcatcaccttttgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgagggcgtttacactcgcgatcaccaaatcattaaagatggcgcattacagacctatcttttaacgacatacagtgctaaaaaattaggtatgcaaacgacaggacacgcaggcggtattcacaactggctagtcaaacctaatcgcacagggggattaactgcattacttaaagagatgggaacaggtttacttgtcaccgaaatgttaggcagtgcgattaatggcgtgactggagagtattcacggggagctgcaggtttttgggttgaaaatggcgaaatacaatatcctgttgcagaaattaccattgcaggacagctacaagagatgtttaaaaatatcgttgctgttggtgatgatattgaacatcgttcgaatattcagacaggttcaattttattggaaaaattgaaagtgtcgggagaataaaacgatgaaaattatcttcaggctgtagtaatatatgcataaactttttatacagtaggaagaccaagtgtggcgttcctactgttctttctttggttcaaagctacataatactagaaaactgattaacataatgtaaatacatgtttcatgtgcttgattcatggtaatagttatttttgtatataaggcaaaaatagagcagtaaagttttaaggtacgacaatgattgtaacgataaaagatcttgctaaagaagcagggggttctttatgtacggtttctaaatgtgctaaatggcaagagtggcgtaagtttagacaaaattgaaaaagtacagcgtgcgattgaaaaattagtctaccaacgcaatatgcaagcggctcagttaaaacgaggtgtaagcaataaaattgcgattattctgccaaatattattgatgtaaaatatagtagcctgtatgaaaatctgaatgcagactttcagcaagataattttatttttgaactttatctcacttataatcaggaagaaaaagagcaagaaattataaaacggattaaagaagaaaattatctttctttagaaacattatcgaactatttttcaagcaatgttcttcacagtttttgccaatttcaacaaaaaatttattaggttccctttgatccaagttttctgatgcttttttatcgtaaagatttatttgaagatcctaaaatcaagcggttgctgaaagtttatcacagctaaaaactttatatcatcattcgattttattagaaaaatgttggtggaaagaagaagtaaaattatttgaacaagggaaaattccgttgttaattgtctatatgaaccactttagcacagattgagcgagagattggggtgttgaatgggtagaaacacggcgtgttcttatcatttaattattcgtaaaagctgattctcagcagagacaggcatagtagacaaacttgtctactatgccccacaaaatggtgtaatagacaaaactgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaactgccaccaataattgtagacgttttaaacagaaaaacttatctgcaactaacgcaaaaacgcaggaattttgctttcgtaagctgcaattttttcttcgtgttgcaaagttaaaccgatattgtctaaaccatttaacaagcagtgacgacggaaactgtcgatttcaaaagagtaggtttttccatttgccgaaaccgtttgagcttctaaatcgacggtaatggtcgcaccttcatttgcttcgacatatttgaaaagttcatcaacttcttcttcgcttaaacgtacaggcaacatttggttatttaaactgttgccatagaaaatatccgcaaaacttggggcgataatagcacgaatgccgtaatcatctaacgcccaaggtgcgtgttcacgggaagacccacaaccaaagttttcacgagccaataaaatgcttgccccttgataacgtggaaaattcagcacgaaatcaggatttggctgtttaccttcatcatctaaaaaacgccattcgtggaataagtgagcgccaaagccgacacgggtcactttttgtaagaattgctttggaataattgcatcggtatcaacgtgcgaagcatcaagtggaactgctaaaccagtatgttgtttaaattcttttgccattttcttattccttagtgtaattctacgttgcgaatatcgacgaatttgccgtgaacagctgccgcagccgccattgcagggctaaccaagtgagtacgtccgccacgaccttgacggccttcaaagttacggttactggttgaagcacagcgttcacctggctctaaacggtcattgttcattgccaaacacattgagcaacctggttgtcgccactcaaagcctgcttcaataaagattttatctaaaccttctttttccgcttgttcacgcactaagcctgaacctggtaccactaaggcttgaacaccatcagcgactttgcgtccttttgccacggcggctgctgcacgcaagtcttcgatacgagagttggtgcaagagccgataaatactttgtcgatagccacatcagtcaatttaatactgtgcggtaagcccatataagctaaggctttttccgccgattgacgctcaatcggatctgccatatcctcagggttcgggatcacatcattgataccgataacgtgtcctgggttggttccccaggtcacttgtggctcaatctcgctagcttctaaagtgaccacagtatcaaattctgccccttcgtccgtgtgcaaggttttccaataagcgactgcatcgtcccaatccttacctttcggtgcagacggacgatcttttaaataagcaaaagtggtttcatctggtgcaattaaacctgattttgcaccaagctcaatcgccatgttacacacggtcatacgaccttccatagataaatcacggatcgcctcaccgcagaactcaacaacgtgtcctgtaccgccagccatcgtagttttaccgataatggcaagcacaatatctttcgccgtaatgccttcacgcactttgccacgcacttcaattttcatttttttcgcacgggcttgttttaccgtttgagttgcaagaacgtgttcaacttctgatgtaccgataccaaacgccaatgcaccaaatgccccgtgtgtcgccgtatgagagtcgccacacacaatggtcatacctggaagggttaaaccctgctcaggtcccataacgtgaacaataccttgattaatatggttgatgtcataaagggtcacgccaaactgctcggtattttttgccagctcaaccatttggatgcgccccatttcgccagaaccgcctaagtcacggctatcggtaggtacgttatgatccattgttgcaaccgttttggtcggctgacgcacttcacgccccatcgcacgcaaaccgtcaaaggcttgcggtgaagtcacttcgtgaaccaaatggcgattgatataaattagaggtgtttcaccttcagcttcgtgaacaacgtgagcatcaaataatttttcgtataaggtttttttcataagtccaactctcaaatgcaaggggacaagcggggggatcacataaaaaattaccacaacatttcaatatggaacataaacgtggggacacactgcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacacactacgtgtgtccctacatcttgttaaaacttcttacaaatccaaccgcttgtaaaagaatgatttggaatatatcgctactcaaaacaaaagtaaaatgctatttttgggaaaattgcatttttttattctgtgaaataggttttaagttggcatattaagttatatgttagcatattatgctaaatcttcttgtttttatggttttaagatttaatgctttggatttattaggatttttatcaatcgaaaaaagattatctgtttttatgaattaataggcaaaagtcattgaagttgctgatttctacaagagagaaaataataggcaataaatccaactaccgtacaagccgccatcgtatagagcattggacgctcgctggttagcggaatatgggataatcctgccccaactaatgaaccaatcccaaagcgagcagtaccagctacggcattggcggtacctgccatttgtggatagcgatctaaaattgccgctgaagcattactaccaatggtcgaaaccattcctacaaaaaatgctacgccaattgccattgaccataagcctaattgcaatgtcgcagaaataatcagccaaatacccgctaggagttgtaagctcattccaatgcgtaacattttttctgagccgattttggtgacaagtcgtccgttgataaaggtcatcaccatcatcacagctatatttagcataaaaaagtagccaaagtattcagatgaaaccccataaagcccaatataaaccagcgagccagaagtaagaaagcaaaacattcctgcaaaggacattccaccaacgagaacatatcctaacgttgctttatgggaaatcaatgtcgtaaaattttgtagtacttgacgaaaactcaacggcattcgattttctgtactcaaggtttcaggaataagcgttgctactaaacaaacgcagacaatccccatcaccattaaaatataaaaaatagcgtgccaatgtagccacttcgctacatatccgcctaaaataggcgctacaagcggtgcgatcatcgtaataatcataatggtggacattaatcgggcaaactggttgcgatcgaatatatctcgcactaaagccccaagtaccactgcaggtgcagctccaaataagccttgtaatagacgcaatagatagaaattttcaatactcaatacttgcgttaagaaaaaagctgcgacagccccgccagataagccaagtaaaataatcggtttacgtccgaaactatcggcaattggtccccaaaaaagttgcccaattgcaaagccgaaagtaaaaatcgcaagagttgtttgcaccttttcttgagataccgacagatcttgagcaatatcgagaaaagatggtagatacatatcaattgcaagcggtggcaacattgagagtaatcccataatcaccacaaaaaatccatttggtttagttatcttgttcatttaaaaactcgctacttcgtcttcagtcaaagctctaaattccccttcagcaagagtttcatcaagcaccacattaccaattcgccagcggtgcaatgcaagcactttgtttccaagagcagcaaacatacgtttgacttgatggtaacgcccttcgctgatagttaaattgacattgtaatcatctaaaatttcaagggtagcaggttttgttaaggttttttcaccacgcaataaaatgccttcggcaaattgcgtggcataaaaatcttccacgggatcagcaagggtaactaagtaggttttttcacaatgatgtttgggggaagtaatgcggtgtgaccattgtccgtcatcggttaataaaactaagcctgttgtgtcagcatctaaacgccctgcacaatgtaattttgtggtaagtggatagtcaaaaaattgaaatactgtcgggtagtcgccatcatcgtgagagcaaacacaattttgtggtttatacagcataaaatattgcccttcatcaacccaagctagcggttcgccatcaaaacagatctcatcttgctcactgattttggttgcactatttttttcaaccacaccattaacagtgacttgccctgtccgtagagctttacttgcctgagagcgagtaagcccagtgttttctgctataaatttatctaaacgcatgttttacctgaaaattgaataaagtgcgacattatatctacattttcataacaaggttaaagatattgacaatatattgatattattccacccacaacggcaattgcattttgacgcgtaatccgcctaatgggcttttttctgctctaactgaaccgtgatgttgtcgtattgcattggcaacaatagataaaccaagccctgttccccccgtttgtcttgctctgtcttcttgaacacgatagaacggacggaatatttcttcatattgatcttctggaacaccttctccatcatcatcaacaagaatataaagatcgctggcatcaatgtaaaacatcacttttacggttgtttgagcatattttttggcgttgcgaatgacattttcgacggcactagctaacaatacaacattgccatttacaaagtaacgctcagggtggaggatacgttggcttacgactaaatcaaatccactttgttccaattcaaatttggcatcatttaatacatcgtcccatattttatggattggaaagacttctcgctctagatggtgattagcttgtttacgagatagaaccaataaatcgtgaatcattgtgtccagttttgtaatttcaccttcaatacgagtaatttcactgctttcaccatttcgacgaagcaagagagataaagctaattgcattcgagtcaaaggggtttttaattcgtgcgaaatatcagataagaggcgatgctgatagttggttagtcgttctaatgcgacaatcatttcattaaaacttgctcctacttgacggagttcttcaatgcctgaggtttctaatttgggattgatggctaagtttcctcgtgctactgcatttgcggttaaacgcagttcttttactggtttggcaatgcggtacgatagccagatcatcactgggctactgacaaaaagaagtaaaagtagcattatccaaggcgagtcaaataatgtattaatgagctctcgttgagggttcacttttttagtgaaatagaggtcgtaagtgcgagtgtgagaacttgcaagaaaagggccgtaaaattccattgtgccgaagcgtctttgtaatggttggaggtgattttttgccttatatataaaagcgtggaaagcttcattattttcctctcttattcctgctaattgttgtgaggcgtgatcaaagaggataatgtcaaaaccattaatagatgctacagagagattgtggcgaaacacttcgtctaaattatattcttgttctacatatttggtttcgtgctgtaaaaagcctaattgaaaatcgtcaatttgcttgaaacgacgagtatctaaacttggcagtaaaatagcaagtgccaaaataatggcaataataaccataaaagaggcaaaaatttgataggccaaatatcttcggaaatttcttagctttaacataacggctcacttatagatagaaaaatcccccaaccatataaaaagctgagggattttactttatgatgattatttttcagtcaccagtaaataaccacgaccacgtaaggttttaaaccatggaaggttatcattacgctcaggaagttttttacgcaaattagaaatatgcatatcaatcgctctgtcgtatggcgttaaacgtttacctaaaatctcaaggcttaagagttcgcgtaaaagaatttgtccggggttacgcattaaaatttgtaacagtgcaaattctgttcctgtaagatctaaatcttttccttcgtaaatcgcttgttggcgaccggggtgaagctcaacgccaccaaattgtaacagttttcggtcgtcatcatcattcacaatgaaagcggtttcaactggcatacttggtttctgcgttattgatctgcgtaagatagcttttatgcgtgcaaccaactctctatcgttaaacggttttggcaggtaatcatctgcaccaagttctaaaccaagtacacggtcgatttcatcatctcttgcacttaacataagaactggggttgagtatttttgacgaacctgttttaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgttttaaggtttcaataccattgagaattggcatcatgacatcaagtagaatgagatcgtaactctgtatctttaattcagttaaggcatcctgaccattgtgtacagtatgaatatcaaagccttcaagagagagtaattctgaaagtaattcagttaaatctacatcatcgtcaacaagtaaaatttttggcatagctctatttccctattccattgatcatttcttgactatttacataaattatctttacataaacagatctatagtattactttacctaattttgtcaatttattctactttttttatttcattccatagaaaatctagttcagataatgtgcagtcttgcggttttttcccttgataaatcagataattctcaatttttctaaagcgattttcaaattttacatttgcattgcgaagtgcagtttctgcgtcaattttgtgatgacggcataaattgaccattgcaaataataaatcgcctaattcttctgctaatttttccggttgctgttgttgaatttcttcttgcacttcagccagttcttcttccactttggcaagcacatcttgcggattatcccaatcaaaaccgactttggcacaacgcttttgcagtttgtctgcacgagtaagggcaggcagagcaaaaggcagatcatctaatatagacgtttgctgtttcgcttctttctctttggctttttgtgcttcccagttttgtagtgcttcttcactgttagtggcagtggtatctccgaaaacgtgtgggtggcgataagttaatttgtcgtgaatatcgtttagaacatcttgaaaggtaaaggttccttcttctttggctaattggctaagaaataccacttgtagcaacagatcgcctaattcttcacgcaaagcggtacgatttttagtataaattgcctccgccacttcataggtttcttccaatagattcgggagcattgtgtcaaaggtctgtttaatatcccaaggacagcctgtttctttgtcgcgtaaacgctcaacgatgtctaaaaattgctgaatagttgccatagtgttttccttaaaaagcgtatttgcgagcttttaaaaaataattaaagattgaaagaaacggttttacctgttgttatgtatagcatttaaacaaaagatatagtagggacgccacgcttggcgtccaatatcaatataatttttacaaatatcaatatcgtagggacacactgagtgtgtccgcccgtaaagtaaggttaaatgaaacagacgccaagcgtggcgtccctaccgacactttaaatggttcattttttatttacggacacacgcagtgtgtcccatactattatgagtatattttgggtgttttatggattgtaatcaacagctttttcaagcgcaatgtgagatttcagtcgaattaatttgttagaacagttggaaacagcattaacatttgtcaatttcagtgaagataggtatgcttgtaacgttcaaaaatcgattttaaggaatggttatggatctcgcttatttacaaaaactcccccaagaagaatttcacactcgtcgtcagcgtttgtttgaacaaatgcaagacaactcaaccttgattgtctttaccgaaacagaaaaacgccgtaataacgactgcgactatttattccgcccagacagctatttttggtatctcacgggatttgctgaacctaaatcagccttagtgttgctgaaaaaagcagggcagtgcgagagcttgatttttttacgcaaaaaagatccgctaatggaaacgtggaacggtcgccgtttaggtattgaagttgcaccacagacgttaaacgtcgatcaagcctacgatatcgaagatattcaaaccattcttgcagaaaaatggacagatttgaccgcttgttactatgcaagaaatgtgcaagcgtggggcgatcagattgtttttgcaacctttgatgccatcactgcaagccgtaaaaaagccccaacaactttgattgattggcaaccgatactctctgaaatgcgattgttcaaatctgaagccgaaattgccttattacaacaagcctgccaaatttcagcctttgggcatttacgagcaatgaaacaaactcgcccaaatcgttacgaaatggaaatcgaaggagaaattcaatacgaattttctcgttttggctctcgctttgcgtcctataatcaaattattgcagggggcaataatgcgtgcattttgcactataatgagaacgatcaagtgttaaaagatggtgatttactgctaattgatgcaggggcagagtttgcaatgtatgcaggcgacatcacccgaactattcctattaatggtaaattttctacggctcagaaagaggtgtatgaaattgtattggaagccttaaaagaagcgactaaactgcttgtaccgcaaagctcgatcaaactggctaacgataaagcagtgcgtattatgacagaaggaatggtacgtttaggcatattaaaaggcaatgttgatgagttaattgagaataaagcctaccgacaattttatatgcacggcttaggacattggctaggcttagatgtccacgatgtcggcgactatggcaatgaacgagatcgaccgcttgaaatcggtatggtgctgaccgttgagcctggattatatatcccgaaagatgccgatgttccagagcaatataaaggcattggtattcgaattgaagataatcttttaatcaccgaatacggcaataaaaatcttacgtcaggcgtgccgaaagagattgcggagattgaggcggtaatggggcaagcgacgaattaatctcttgaataagctagaaaataagactagactcacttatcggactaagaaaaaggggctgttatgctaaatcaatctttagaaagtgtgaatatgcacgaagcaaaaaccaatttttctcgcattgttgaagatgtgaaacgttttggaaagccgatcatcatcgcaaaatcaggtaaaccacaggttaaaattgtgcctttggatactatacaaaatggcagtcgctttggttttatgaaaaagcaaaatatgcaaattcctgaagattttgaccgcttgtatcaaaatgaaattgtggcaatgtttgaaggaaaagaggaatgaagatcttagtagacagccatattttgctttggcttgcgtgggataaaaaagaaaacctatcgccacaagcggtggaattacttgatgacccgaccagtgaaatctattttagtttagcaagtttatgggaaattgcgattaaatctagtttaggtaaacctgattttgacattgatgtagaagccttagagcaaggcttaattcaggtaggttgtcgaatgctagctattgaattaccccatattctaaaacaagctcagtatccttttattcatcgagatccctttgatcgtctattaatggctcaggcggaagtagaaaatgtcttttttatgaccgcagatactatgattttgaagtatcagaaaccttatattatcgacgtgagaagctataaaaattgaaatttttgacagccccatatttccgctagaatgcaaagcaccattttttataagaggcaaacacaatgacacaagtttataatttcagtgcaggcccggcgatgatgccgactgccgtattagaaaaagcacaagcagaattgttgaattggcaaaatcaacacacttcagtaatggaagttagccatcgtggtaaattgtttatggaaatgatcgcagagtgtgaacaaaatttccgtaagctctataacattcctgaaaactacaaaattttattcctacaaggtggtgcgagagggcaatttgcggcaattccgatgaacttaatcggcgaaaaaggcaaggcgctttatttaactagcggtcattggtcagcgacagcggcgaaagaagctcgtaatttctgtgaaattgatgaaatcaatattttagagcaaggcgatgaactcaaggtgggtagccttgattttagcgagattgcagaacagtacgactatgttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaaaagtgggcaatgcggtgttagtggctgatatgtcctctaacattctctctcgtgctatcgatatcagcaaatttggtatcatttatgcaggcgctcagaagaacttagggccggctgggattatccttgtgattgtgcgtgaagacttgattggcaaggctcgcaaagcaacgccatctatttggaattacgaaacccaagctaacaatgattcaatgatcaacacgccaccgacatttgcttggtatctctgttcattggtattcaaacatctgcttgaactaggcggtttagctgaaattgaaaaacgcaatcaagctaaagcagaattactttatcgctaccttgataacagcaacttctaccgtaacactgttgctaaagcgaaccgttctttaatgaatgtcacctttaccacaggcaacgacgaactcaatgcaaaatttgtggcggaagcgaccgcttgcggtttacaagccttaaaaggtcacaaagtgttaggcggtatgcgtgcatcaatctacaacgcaatgccgattgaaggcgtgcaagcgttgattgcgtttatgcagaagtttgaggcagaaaataaataatctgacctattgaacggacgccaagcgtggcgtccctacaataacgttgaattagggatattcgaaaaaaataaaatccgaagtatttgtagggacacgacgcatcgtgtccaaatagcaaagtgtaatttattgatttttattgaaatttctcacggagatatagtataatgcacagcacagcacagcacagcacagcacagcacagcacatctggctgaaaatttagctactcagcaagcagatcaacaagcctttctcaacaaactcgattccgacctttggaaagccgctgataaacttcgccaacagcttgacgctgccaactacaaacacatcgttctcggtttaatcttcttaaaatacgtttccgacagcttctcggcacaacaagacatcatcaaacaacgttacaccgatccaacgtccgatttttatctcgatccgaccgcttacagcgaaagtgaacttgcctatattctcaatgccgaactggaagagcgggacaactacgcccaagacaacgtattctgggtgccgcaacaagctcgttgggacgaaatcaaagtggtggcaggggtaaacattggcgacaaaatctggggcgagaaaacctttaaaggcattgccaacttgattgatgatgcctttgatgccattgaacaagacaaccctaaactcaaaaacgtcattcaacgcatcagcccttataaagttgatgaaagtattttattaggcttaatcgatctcttttccgacaccaacttcacccgtccaacccttgacggcaagccgatttccttggcggcaaaagatattctcggccacgtttatgagtattttctcggacaattcgcccttgcggaaggtaaaaagggcggtcaatatttcacgccaaaatccattgttaccctgattatcgaaatgctcgaaccctacaaaggacgcatttacgacccagcaatggggtcgggcggcttttttgtgcaaacagaacgttttatccgcgaacatcaaggcaacgtcagcgaagtgagcattttcggacaagagttcaacccaaccacttggaaacttgccgcaatgaatatggcaatccgtggcattgaatttgacttcggcaaaggcaacgccgacaccttcagcaatccgcaacaccgtgataaaaaaatggattttgtgatggcaaacccaccctttaatatgaaagactggtggaacgaaagccttgcccaagacccacgctggcaatacggcataccgcccgaaggcaacgccaactttgcgtggctacaacatatgatttaccacctttcgccaaacggacgaatggcgttgttgcttgccaacggctcaatgtcatcgaacaccaacaacgaaggcgaaatccgcaaaaatattctcaaagccgaccttgtggaagcgatgattgccttgccaagccagctctttaccaacacccaaattccagcctgtatctggattttgaacaaaaataaagcacgcaaaggcgaagtgctgtttattgacgcacgccaacttggctatatgaaagatcgtgtcttacgcgactttaccgcagacgacatcgccaaagtcgccgacacctaccacagctggcaacaatccgctgactaccaaaatatccctgcattctgctacaccgcaaaccttgacgaaatcgcccaaaacgacttcgtccttaccccggggcgttatgtcggtgccgccgaacaagaagatgacggcgtaccatttgcagaaaaaatgcaagaactgaccgcacttttacaacaacaatttaagcaaagtgcagaattagaagccaagattaaagcgaatttgggagggttggggtatgagtaagttaggggattttgttagagttcagggcggttatgcatttaaaagtagtgagttatctgatgataagacaggtgttcctgtgatcaaaataggcaatattacaggaggaagttttgttgatctaagtaattatcagtctgtaagttttcaattatttgaaaaaacaaaatcttttgcaacaaaagataatgatattttaattgcgatgacaggtgctaatgttgggaaaacatctagagtacccgttaattcagatgcttatttaattaatcaaagggttggaaggtttttattaaaagaagattgtccatatacttcagattttatttattatgtcgttagttcgaagcaagcatatcaatacttttcaagagttgctgatggagctgcacaaccaaatattagtggaaaaacaatagaagacttagaatttcctaatatagatagtcgatgtgcaaataaaattggaaatatattaaagtccttagatgacaaaatccaactcaacacccaaatcaaccaaaccctagaacaaatcgcccaaacgatttttaaaagctggtttattgattttgaccccgttcacgccaaagccaacgcactggcaagcggacaaaccttggagcaagccacccaagcggcaatggctgtgatcagtggtaaaaacacgcaagaattacaccgattgcagacggcaaatcccgaacaataccaacaactatgggaaatcgcagaggcgtttccgagtgggtttagtggatataaaaatctaggggaaattcctattggctggaatgttttaacattcaaggattttataagtgaaagtaaagagaaaattggttcattagaagatgtgccagaatactctgttggaaatgagggtatttatccaagatcagaaaaatataataaatccctgtctaaaacaccagagaaaaacaaagttgttaggataggggatctagtatttggtatgggatcaaaaacgctgaattgggggataatgaatgatgagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaaccccgtacgcttgcgtgcgggggaaataaatttggggcgaaagatgtttcgctcctacgatatatcaacaaaaaaggaaaaaaacaatgctcatcaacgaaaacaccattgaacaagcctgtttgcgatttttgcaggaattgggttgggattatacgcacggttcgaccatcaatgccgatggggaaaatccttggcggttgcggacggacgaggtggtgtttcgttcggtgttgcgtgaggcggtggagcggttaaatccgcagttgccgtctgccacgatggacgaagtggtggcgttggtgtgcaaaacggatattacagatttaacggagcgtaatcagcaagcctatcgctacttgcgtgagggtgttcgggtggaatatcgggaaaatgatgagcaaaaggtggagtttgcccgtttgattgattttcaacagccaagcctgaaccgttttgatgtggtgaaccagctgacgattttggggcggaagggtaatcgccgtcctgatgtgatttgttatatcaatggcttgcctgtggtggtgttggagttgaaaaatcctttgaaagagaatgcggatttgccgcaggcgtttaatcagttgcagacttataagcaggaaatcggcgatttgtttgtgtataaccaagcccttgtgattagcgatggtattttggcgaaggtcggttcgctcacggcggatttggagcggtttaccccttggcgtgtggtggacgagaagaacaagcaacgtatttcctttgaacacgagttggaaggcttggtgcgtggtttgcttaaccctgcgagtttgttggattatatccagaattttattgtgtttgagcaaacctcaagcggtcgtttggtgaagaaaattgccgcttatcatcaattctacggcgtaaatgaagcggtggattgtacgctgtgggcggcaagcgagcagggtaatggcaaaatcggggtgatgtggcatacacaaggttcgggcaagtcgttgtcgatgttgttttatgcgggcaaattgttgtcgcaagcggagttacgcaatccgactattgtggtcgttaccgatcgcaatgatttggacggtcagctttatgccaccttttcaggcggtcaggcgttaattcgtcagcaacctgtgcaggcagacggcagggaggcgttgcgtgaagaacttgccaagcgtgaaacaggcggtgtgatttttaccactattcagaaattcggtttgcaagagggcgagcaggctcaccctgtgctaaacgagcgacacaatattattgtgattagcgatgaagcacaccgttcgcaatatggttttagccaaagtatgaagctcaacgaagcaaaccgcacggggacatatcgggtgggctatgcaaaacatttgcgtgatgctctgccgaatgcctcttttattggttttaccggcacgccgattagtcttgaagataaagatacgcaggaagtgttcggtaaatatgtgtcgatttacgatattaccgatgcggtggaagatggggcgacagtgccgattatttatgaagcacggcaaattccgattgcacagagtgccgagtttgataatgtggtgcaagaagcccaaacgttaatagatgaagatgatgaaagtagctacaacttccgtttgcgtgaaaaattaatggggacagaggggcgtttgagccgtttggcagaagattttgttaaacattttgaacaacgcaccgctttaattgacggcaaggcaatggtggtggcgatgagccgtcagatttgtgtgaaattgtacgaaaaaatcaccgcacttcgtccagagtggcatagcgatgatgtgaatgaaggggcgattaagattgtgatgacggggtcggcgagcgatcctgcggacattcaaaaacatatctattcttcgcaagataaaaagctgttagaacgccgttttaaagatcctgacgatccgctgaaaattgtgattgtgcgtgatatgtggctaacgggttttgatgctccgtgttgcaatacgatgtacattgataagccgatgaaagggcataatttaatgcaggcgattgcacgggtaaaccgtgtgttccgcaataaaagccgtgataatggcggtttgattgtggattatgtggggctaaccagcgaacttcgagaggcgacagaacaatatactcgctcgcacggcaaagggcagatgacccacaatatcgccgaaattaaggcaaagatgttggaatatattgatgttgtgcgtgggcagtttgctacacctgtgaacgatcagccgtttaagctgtttgatgccttgaaaattgaagatgaactggcgttgttcaagcaagtaatgttgggggcgaaccatattctcgccttagatcatcaaacggttgcggataaaaccgagaaaaccccaagacgcaatgcgtttttaaaagcggtacgtttggcgaaaaaaggctttagcttatgcggtgcagacggcgatgttcagcagtaccaaaaagagcttgccttttatgatgcggtgcgtgcgattttggcaaaacgtgagccaaattccaccgcttcaagcgaagaacgtcagttgcagttggtggcattattaaataaagcggtggacgcaagcggtgcgattaacctgtttgatttgctcaaccgtgaacagccgaatattaatattttgtcggaagagtttttagagaaaatcaaaaacagtcaaaccaaagagctttggctgttggcggtggagcgttatttgcgtagccaaatcaatgaaaaaggaacaggcaatttggcggtgcaaaaagatttttccgagcgtttgaaagaggcgttaaacaaataccacaaccaaaatctcaccattatgcaagtgttggaagagttgctgaatatgagcaaggaatttgccgaacgcttgcaacgtggggagaaattgggtttatcgccagcagaaattgccttttacgatgcccttgcccgcaatgaaagtgcggtgcgagaattgggcgatgatgccttgaaaaacttggcaaaagcgattaccgataaactgcgtaaatccgccactattgactggcaatataaagaagccgtgcgtgccaaaatgcgaaacttggtgcgtgtaacgttgagattattcaaatatccaccagataaatgcgatgaggcaatccaatttgtgttggaacaagcggaagtgattgcggatgaattgacgacggtataaactgcaacgaaacattaagaaaaaaggaacaacaatgcaatttatcaacatcgccaacgagggcgtgaaaactcttgccccttatcaagcggggaagccgattgaagaacttgagcgtgagcttgggatttcaaatattgtgaaacttgcctcgaatgaaaaccccttcggttttcctgaaagtgcgaaacaagcgattttaaagcagttgaatgatttaactcgctatcctgatgccaatggttttgagctgaaagcgaccattgagaaaaagtttggggttcagcctaatcaaattaccttaggaaatggctcaaatgatctgcttgagctgtttgcccatacgtttgccagtgataaagatgagattatttattcgcaatatgcctttattgtctatccgcttgtgactaaagcgattaatgcggtagcgcgtgaaattcctgcaaaagattggggacacgatttgagagcctttgagcaggcgattaatgacaaaaccaagttgatttatatcgcgaatccaaataatccgacggggaattttttatcgcaacaggaaattgaacgctttttagacagagtgcctgtaaatgtgattgtggtgttggacgaggcttatacggaatttaccgatcctgctgagcgattaaattcttttgcgttagtgcagaaatatccgaatttgatcgtctctcgttcgctgtctaaagcctatggtttggctggtttgcgtattggttatgcggtttcgcaccctgaaattgcggatttattaaatcgtgtgcgtcagccatttaactgtaatagtcttgcgttagcggcggcaattgcagtgatgcaagatgatgattttattgcgaaagtggcagaaaataatcgtaatgaaatgcaacgctatgaggcgttttttaaggcaaatcagttggaatatattccatctaaaggcaattttattacggtagatttgaaacagccagcacagccgatttatcaggcgttgttgcacgaaggggtgattgttcgtccgattgcaggctatggtatgccaaaccatttgcgtgtgagtatcgggttgccagaggaaaatgatagattttttatggcgttgaggaaggtgctgatttagaaggcatagtagacaaatttgtggcgtaccacttaaaaaaataggcttccgatggaagcctattttatttgtaagaaatggaattttcttagaatttgtatgaaataccagtgaagtaaacgataggatcaagtttgatttttacttcgtgtgataaacctaaagcatcaaagtttgcttttgttttaatacgggtgtaccacattgctgtgtttaatgatactttctcggtgagtttaatatcaataccagcattagcaacaggaccaaatgagtgttttttcacttgtaaattggtaattgcaggattaagagctttagcaccgaagaaaagggtataatttaacctcaactggagttgttgtttttgagctagagtttgcattaacaaaaacgccccctgcacgaacaataaagctacctgcttcgtgtgctactgctgagcctgctaataatgcacttcctaaaaatacggctaacgctgtttttttcatttttaatccctcattttgttatagttgaacatcaaaagtaattgttttgttatttaatggtaaatattgtaagaataagtaagcaaatgttttttgataaatatcaaaaaatagcggtttatcaggaaacttttcttaatatacccattagcgttctgtcaaaatttgatccaaaacaaatgcctgtatctatttacagttaaactggttttatatataatgtttttatatacagtaatcaggtgagaaaaatgttatgcaagcaaccattgatattcgtttagccaacttacaaaaaatggatcaaggtaaattcaacagacttttagacattgtggcagagcaagtcgagaaagcatttccaaatacgattgttcgagttcgaccttcggtatctaatagtgatcttgctgtttttgggctaggcaaagagggaaaacaaaaagtggctacctttttggagcaactttttgaggaaggatccgcatttgatgaactgcaagatgagtattattgattgtcttgtttttgctaaaactgaccgcttggtaagacacaaacgctaataggttgtgaatggtaataaaaatcgagctgataggcgtgtaaataaactctatcggctttttcaccaccataaagctcgtcgccaagaatggggctacccagacttttcattgccacacgcagttggtgagtttttcccgttttcggctggaggataaattggcgtaaatgaggggcaatcgatatagagtgaaaatgggtaatcgcaggattttctgtggagtggcataatttccagcttccatttcggctttttgccatatcaccgataattttgccttgtttctttttcggttttgctgttgctaatgcccaataggttttttggatttggtgttgagcaaaaagctcgccaaaataacttgcacttgttgggtttagggcaaggatcagcaagcctgaagtgactttatcaagacgatgaaccagccacacttgttctacaccaagctgtttggcaagttgttgcgttaatccttccgcttgatcgtccttatgaacgctaatccctgcaggtttatcaataataataaagtcttgatgttgatagcagacggtaaagttcatcattttttgttatactctttccattaaaaaagatactttaacctttattggaaagaaagcaaatggcattacacatttatttagtgcgtcacggtcgaacagagtggaacattgaagggcgtttacaagggactggcgactcgcctttggttgaagaaggcattttaggagcaaagaaaacaggaaccgcattggcggatattccctttacggcttgttattctagcttgatgaaacgcgcccaagatacagctgactatattattggagaaagagatattccccattttcatcatcgaggtttaaatgaatttagttttggtttatgggaagggcagaaagttgccgatctggcggaacaccccgaatatatcctattaaaaaccgccccacatctttatcaagcgattgaaagtcaaggggaaacctttgaacagctctatcaaagggttactcaggcattagaacagatcattactcgacatcaagagggggaaaatgtcctgattgtgtcgcacggaatgacattaacactgcttacagccgtattaaaagggatccactggcattatttccgtgatccggaacagcacacttttgtacagaacaccgccctgagtatcataaaagttgaaggggaaaagcgagaattaatcgaatttaataagacagaacatttataaatctcttcctaaataacttactaaaattggtgtaatagacaaattggcacagtagacaaatttgttgctaaaaacgggcttaaagccttatcattcatggtttaaacaataaggcgagatattctctcgccttatcttatctttttccaaaaattagaaattcgcattacgcggtgcgcgtgggaatgggattacttcacgaatattttgtaaaccagttacatatacgattaaacgctcaaagcctaaaccaaagcctgagtgtggcactgtaccataacggcgtaaatcacgataccaccaataatcttctgggtttaagcccatttcaaccatacgtttatctaacacctctaaacgctcttcacgttgtgaaccaccgatgatttcaccgattcctggcgctaatacgtccattgcggcaacggttttaccatcatcatttaaacgcatatagaacgctttaatatctttcggatagtttttcacgactactggagatttaaagtattcttctgcaaggaaacgttcgtgttcagaagagagatcgataccccaagaaaccgggaattcaaaatctttacctgatttaagtaaaacttcaatcgcatcggtatagtcaatttgagcgaagtctgaattaataaagttctctaaacggctgattaccgtgttatcaacgtgtttctcaaagaattttaagtcatctttacgttcttcaagtactgcacggaacacatacttcaacatatcttcagccagttttgcattatccgctaaggttgcaaacgcaaattcaggctcaaccatccagaactctgctaagtgacgggtagtgtttgagttttctgcacggaatgttggaccgaacgtataaactttgcttaatgcacaagcataggtttcgccatttaattgaccagatacggttaagaaagactcttttccaaagaaatcttggctgaaatcaactttgccatcttcaccacgcggtaaattttctaaatctaaggtcgaaacacggaacatttctcctgcaccttctgtatctgaagcggtgattaacggtgttgcaacccaatagaaaccttgctcgtggaagaagcggtgaatggcttgtgctaaacagtgacgcacacgtgctaccgccccgattaagttagtacgaggacgtaagtgagcaacttcacgtaagtattcaatagagtggcgttttgctgccatcggataagtatcaggatcttcaacccaacccacgacttcaacagattttgcttgtaattcaaccgcttgtccttcagctggtgattctacaatcacaccagtcacaatcacagaacagcctgcagttaaacgtaatacttcatcttgataattacttaaatcgttattgataatggcttggataggatcgaaacaagaaccgtcatacacggctaaaaatgataaaccagcttttgagtcgcgacgagtgcgtacccaaccacgtacagcaacttcttcccctacggcaactttgccagaaagaatctctgaaattgttggaaatttagacatatttataccttttaaaattttgctcaagattttgtagaaaaatcgttagatttatcgcagacggtcgattatagagaaattttccttgtaagactagtaaaacaagcggttaaatcccctttaaagaatacgatattatgtggcagctaaaaactagtgttgtgtagggtggggataaccccagtccctacgaaaagttataatttatgtaagtgctacataatgttaggttttagaaactaagatctaagcctaagataaaatttctgcctatttgtggtacataggggtgataagagttgtgaatgtaaacggtttgatttaacaagttatttcccgtcaaactaacggtatattccacaccttttatttgtctgcggtaatttaaactcgcattgagtaattgatagccttttgttgaactttctaatttggagactttattttgtgtaaagactttcatccattcaactgaacctgagaggttttctgtcaattgtgcgttaaatcttgcccctaaacgtataggcggtagacgtggcgaaacacgatctgcctgtttaatcatctctttgcctaagtaaggacgatagtattgctcttctggttcatcatattcaggatcgtaatcaggattaagaattggctctccatagacatcatttaatccttttatgtcgggtagctgttttaattttccttttaccatatcgccaaatacactgaattgataatcaggcgtaaaacggtagttaataatgccttcaagtccataaaatgtggctttagcttgattataacggcgcataaagaggttattagagcgatataatgtttcattgtagatataattatcaaaattattgtaataggttgataatttgtaatctaatttttctgtatggtagcccaaacctaattcaaaattattggaaatctctttttttagatctttgtttccatattcaaacgagtttgttgccaaatgttgtccgtgataataaagctccatcggagttggtaaacgttcattatgggaagctgtaaacgagagctgatagtctgggtggaaaaaccaattaaatgccccagtataggagatggctttttcatcataatcagataaatcaggatcaacctgtttaccataagtcctctcattgaatttttgttgtttttgaatcttagctaaatcatagtcaatatgaatattctgcttttcagttcgcaatcctaattcaatcgcaaagttatcccaagcgtattgttccaaagcaaataagctaatttgcttgttgcgattatccactaaaggccattgaacttcacggttgtttggtgtattagcgctgctttgcagggtttgatactgtacgccaaacattccagttaagccaccaattggcgtatgaaaaaactccaagcgggcatttttgccttgatttttgaaaatattgacgggtttaccaaaatctttgctcttatctactcggtttgggttgattgtatcgcctgattttcctgcgtctttttcatcgtgatagtaatctgtttgagcataacttagctgaattttatccaacatcggcaaaggttgtttaatctctccctttatatcaattcgtttagagtgtaaatctacccaaggtccaatatgggtatgatcgtggtcgtgtccataagggtgatcgtggctatggcttggatcgagatcgtagtctgtaccacaatgaaagtgaggattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgaccatttcatcactcattaaatggggataaagattggtataagaatgctttccttgcaatctcatatcgtaaatatgggcaatacaagtatcaaatttatgattatgcccaggtaatccatatctgtctttacgctgattataagacgctccgagataacctttttcaccaataaaagataaaccaatagttcctacttttgattgatgataagtatctggcacataatttaatgtttcacctagtttaatttgtggcactttataattttgcgattgacgatctaacccttcaagtcgtaaagctaaatgtttcccaattccaatggttgtacctagtgcatacactttctctttgcttgccgtatcaaatcgactggaaagtgtcacttcataaccttttttaggcattttatttggaatacgttgatcaacgatattcacaattccagcgggagagctacttgcataaagcaatgttgaagcaccgcgtaaaatttctacttgattagcaagtagagtatctgcagtgatagcgtgatcgggagaaatatttgacatatcaacaacatcagcattattttgcaaaatcttaactcgaacaccttcttgccctcgaataattggggcgcttgctccacctccaaatggggtgctatgtacgcctaattcactagatagagcattccctaatgttgcagaacgatttttgaatttctctccatcaataatagcatcacttacttttagaaaacttatcgaatttccctcaggaacttttcccattacagaaatttcatcaagttcaagctgctctgcattaatacctaagcagcatagtaataagctaaatgctaagctaaatgctgttgtgctgttgtgctgttgtgctgttgtgctgttgttgatcattacctctccttttaaagccataaaaaaataatgggataatgtaacaaaaagacaaaaacggatcaataacctcaaattaataatgggtatataacttaaaaaatgaaaaaataattgttcagtaccacgattttgaatgaaaaagtgatacactttgctttgaattattctatttggggtgctttatgtcggaaatgccttcacgcgaatttgctgcgattgatttaggctcaaacagttttcatatgattgttgcaaggattgttaatggctcaatccaaatcctttctcgtattaaacgtcgtgtacgtttagcagaaggattggacgagcatcgccacttaaatcaagaagctatagacagaggcattgcttgtttagcactctttgctgaacgtttaaaagggttctcgcctgaaaatgtgaaagtcgtaggaacttacacattacgcagggcattaaacaatcaagattttttaacacaagcacaacaagtattcccatttccgattaaaattatctcagggcaagaagaagcacgcttaatctattcaggggtaagtcatacacaaccagaaaaagagcgtaaatttgtggttgatattggtggtggttcgacagaaatgacgataggggatggcttcactccattacgagcagaaagtcgccatatgggctgtgtgagttttgcaaaacgttttttccctgctggtgaactaactcaagcacgttttgaacaggcatatcaaacagcgatggaaaaaatcgatgatttggcgtgggaatatcgtgagttaggttggcaacacgttctaggctcttcaggaacaattaaaaccgtgagcaaggtgttgattgcaaatggctatcgagatggattaattacagaagcacgtttacaaaccttaattgatcgttgtttagcatttcattcactcaaagaaattcagctcaaaggattattggaagagcgtgccgatgtcttagtgccagggcttgccattttactggcgttatttcacaccttccatattcaatcaatgcgatattccgatggggcattgcgtgaaggaatcttatatggtgttgagagcggattccaagttggagatattcgacaacgaacagcaaaagccctcgcagaacaatttaatatcgatcaacatcaagcagaacgcataaaagacaccgcattacgtttgtttgatcaagtgaccgcttggaaaaataaacgtcaaatacaggaattacgagaaatcttacaatgggcaagtttattgcacgaagtcggtatttcaattaatcacaacggtgttcaccgccattctgcgtatattattgcaaaccgagatctaccaggttttgattctgaacaacaaactttgttagccatattaatgcgttatcacctcaaaggatttaaacgacacgatctcaaaattgcaagtcgctttcagcaccctgatattttaaccctattacgcatattccgcttggccgtgttattgaatcgttcacgtcaggcaacgaatattccaatggaacttaatttatctatccaaaattcatcgtggcatttatcctttgataaagtattcttggcgcagaatcctttgatattggcggacttgcttgatgaggctaggcatttacaagcagttaatttgacgattgattttagctaaaagcaccttattaaatttattattatgctattaaagtaaaaattgagtaaaaataaaattttcttatttatttcataaaaaaaactaaatacgattgccatttgctctctttttcggtatatctacacccagttaatttttatcgaaaagaggacattttatgagccaaatttatgaatccatgcgtagtaatattcatatgttgggagattttttgggcgaaacgattcgcgatgcccaagggaatgaaattttagatttaattgaaaatattcgtatattgtctcgtgcatcacgttcaggtgatgaaaaatcacgtgagcaacttcttgatattcttgccaatatttcaaacgaagatgttatccctgttgctcgtgcctttagccaatttttaaacttaacgaacattgcagagcaatatcacacgatttctcgtcacaataaagatgcagcgttaggtgaacgctctatgggtgctttatttactcgcttaaaagcgcaaaatgtgcctgctgaaaaagtaattgcaaccgttgaaaaattgttgattgatttagtgctaaccgctcacccaacagaagttactcgccgttctttagtgcataaacacgttgaaattaatcgctgtttaagccgcttagaacacgatgatttaaccgatgcagaaaccacaaaacttaaacgtcgtttgatgcaattaattgcgttagcttggcataccaatgaaatccgtactcaacgcccgacccctgttgatgaagcaaaatggggtatggcggtaattgaaaatagcctttggaaagcggtacctgaattttgtcgtcaattaaatttccatttagagaaaaactttggtgttcagtaccctgttgggcttgcacctgtgcgtttttcttcttggatgggtggtgaccgtgatggtaacccgtttgttaccgcagaaacgacacgcaaagtgttgcgtatgaaccgttataaagcagccgagcttttccttgaagatattaaatcattagccgacgagctttctgttattcacgcaacagataccttccgtgcaaaatatggcgatcatttagagccatatcgtgtggtggtgaaagatctgcgtgccaaacttatcaaaaccttagcttattatgatgaactcttgcaagataaaccgcttaccattagccgtgatgaaatcttaaccgatgacgagcaactttgggaaccgctctacgactgttatcaatcactacaccaatgcggaatgcgtattatcgctaacggtggcttattagattgcttacgccgtattcgttgttttggtttaggtttatctcgtttagatattcgtcaagaaagtactcgtcacgaaatggcgattgcggaaattacacgttatatcggtttaggggattattcacaatggacggaagatgataaacaagctttccttgtgcgtgaattaagctctcgccgaccgcttgtcccaaccaactggacaccaagccctgaaacgaaagagattttagatacctgtaaagtggttgcagaacagcctgaaggcgtgatctctgcctatgtgatttctatggcgcgtgaagcctctgatgtactagcggttcatttactcttaaaagaagcaggttgcaaaacaaccattcctgtttcaccgctatttgaaacattagacgacctcgatcattgcgagaaagtaatgaccgatctattcaatatcggctggtatcgtggtgtgatcaacaacaaacagatggtaatgatcggctattctgactctgcaaaagatgctggtatgttagctgcatcttgggcgcaatatcgtgcacaagaagcgttggtgaatttatctgagaaatacaatgtagaattaactttattccacggtcgtggcggtactattggccgtggtggtgcgccagctcacgcggcgttactttcacaaccgcctcgctcactcaaaaatggcttgcgtgtcacagaacaaggggaaatgatccgctttaaactgggtttacctgccgttgctgtatcaagcctagacttatacgctagtgcgattttagaggccaacctttgcccgccgccagaacctaaacaagaatggcgagatgtaatggataaaggctcggaaatttcttgtgacatttatcgtggcattgtgcgtggcgaacctgattttgtgccgtatttccgtgcagcaacgcctgaacaagagctttcaaaattaccactaggctcacgccctgcaaaacgtaatccaaatggtggcgtagaaagtttgcgtgcaattccgtggatctttgcgtggatgcaaaaccgcttgatgttgcctgcgtggttgggagctggtcaagcgttacaacagttgatcgaacaaggtaatgaagcactattaaaagaaatgtgtaccgaatggccgttcttctcaacccgtatcggaatgttagagatggtctttagtaaagcggatttatggcttgcagaacattacgatcagcgccttgtaccacaatatttacaccgtttaggaaataccttacgcaatcagcttgcagcggacatcaacagcgttctctcgcttgctcacgaagggcaattaatggcggatttaccttgggtagcagaatctattgctctgcgtaacgtttacaccgatccacttaacttacttcaagttgagctgcttcaccgcttacgtgctgaaggcgaaaatccaaatccagccttagagcaagcgttgatgattactatcacaggtattgcggcaggtatgcgtaatacggggtaggggagtatattctggattacaacctcttaatgaattctaagaggttgtttttttagatattataaaaactatttaattattaggatttcattatggaaaaattaacactaaatcctatcgctcgtgttgagggcgaaattaatttaccgggttcaaaaagcctttcaaaccgtgcgttgttgttggcagccttggcacaggggacaacgcaagtaacgaatttattggatagcgatgatattcgccatatgctcaatgccttgaaagctttgggggtgaattatcagctttctgataataaaaccgtttgtaccgttgagggcgtgggcggtgcgtttaagtggcaaaatggtttgtcgctgtttttaggtaatgccggcaccgcaatgcgtcctttaacagcggcactttgtttgaaaggtgagcaagaggctgaggtgattttaacgggcgagccgcgtatgaaagagcgtccgattaaacatttggttgatgcgttattgcaagcgggggcttccgtgcaatatcttgaaaatgaaggctatccgccgattgctattcgtaatttgggtattcaaggcggcaaaattcagattgatggttcgatttcttcgcaatttttgaccgcacttttgatgtccgcaccccttgcctctggcgatatggaaattgagattgtcggtgagttggtctccaagccttatattgatattacccttgcgatgatgaaggattttggcgtgacagtgtcgcataataattaccaaactttctttgttaaaggtaatcagcattatgtttctccgcaaaaatatttggttgagggcgatgcgtcctctgcctcttatttcttagccgcaggggcaattaaggggaaagtcaaagtgacagggattggtaaaaattccattcaaggcgaccgcttgtttgctgatgtgcttgagaaaatgggcgccaaaatcacttggggcgaagattttatccaagcagagcagggggagcttaaaggtattgatatggatatgaaccatattcctgatgcggcaatgacgattgcaactaccgctctttttgctgagggtgaaaccgttattcgtaatatttataactggcgtgtgaaggaaacggatcgcttgacagcaatggcaacagagttgcgtaaagttggggcggaagtggaagaaggggaagattttatccgtattcaaccgcttgcgttagataagttccagcacgctgaaatcgcaacctacaacgatcaccgtatggcgatgtgtttctctttggtggcgttgtcaaatacgtcggtgacgattttagatccgaaatgtacggcaaaaactttcccgacgtattttgatgaatttggtaagatgtattgtaattttagtagggaagaaaaataatcttattgggattgaggctattttaaacaagcattaagaggattcaaaagacgggtactgtctacctgttaaggttttaattactatttttgtctattatgccaaagtctttattaagggtaacaaattaggggctaaagtagcccctaagaaattattcagtaattggtacaatgcgtacagctgaagctcccttatctccatgagtgaactcaaaatgaactttttgtcccatttttaaagagcggtagccttctccttcaataactgaaaagtgagcaaaaatatcaccttcatatgagtccgaagtgataaatccgaatcctttggcgttgttaaaccattttacaataccaacttccataataatgtttctcccttggttagattatgatgtaaattttagtcaaatatgtaaaatgcgcaataggaaaaattaaattttacgacatagatcacaaatttttatttaaaaccgaattgtgaaaatcttcctatgcttaatattttagtgcatatttagaatatgatatacttattgtctctataatgagctaaaaggaataataatggatacattaagggtgggcgatactgtaccatcattctctctattagatcaaaattttaattgggtaactctagagcaatttccaaacaaaaaatttctaatttatttttatcctaaagcattaacaccaggttgtacatcacaagcatgtggtttacgtgatagcaaggaagaacttgattctttaaatgtgatggttctgggcattagtcctgattcgccagaaaagctagcaaaatttcttgagaagaatagtttgaactttattctattgtcggatgtggatcataaggtagcagaagcatttggcgtgtggggaaagaaaaaatttttaggaaaaagttatgatggggttcaccgaattagttttttagtggatgagtatggcaaaattatgtctgtatttaataaatttaaaacaaaagaacatcaccagttggtaattaactttttaaaaggcaatagtgatggcgaataaagctatttttctggatcgagatggtacaattaatattgatcatggctatgtacatgatattgatgatttcaggtttattaaaggcgttggccatgcattaaagcagttacaagataaaggatatatgctagtgatagtgactaatcaatctggaattgctagaggctattttagtgaagcacaatttcatcaattgacagaatggatggattggtcattagatgaagactatggtgtggtattggatggtatttattattgtcctcatcatcctgaaggaattggtaattataaaaaggcttgtgattgtcgtaagccaaaagctggtttattgctacaagctatttctgatctggatattgacccttcaaaatctatcatggtaggagataaattagaggacatattagctgcgaagaacgctggggtgaaagtgaaaatattggttcggacaggtaaaccaattacacctgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgaattaaacgctgattatgttattgatagtgttgctgatttacctaaattcatagatggccatgtagatgaaatgatgtagtgaacacatttaaatgttgattaatcttaaaaggagaatgggtagttttatttaatcaaagaatattgaggtataatagcatttgatgcatcatattgtatttttaaatagtatatagataaaaggtttgtttatgaaaaaacatcacattgaaactatgatatcttctcaagaagttcaaaaccgcattactgagttagcagaacagattaatcaacattaccaacataaaaatagccagagtctggttgttgttggactgttgagaggatcttttatgtttatggctgatttggtgcgtaagttaaatttacctgtcgaggtcgattttttaacggcatcaagttatggattaagtacagaatcgagcagagatgtgaaaatcttgaaggatttggatagtgaaattcaaggcaaagatgtattaattgtagaagatattattgatactggttttacccttaacaaagtgcatgatattttaaatttgcgcgaaccttcctcacttgcgatttgtactttattagataagccttctcgtcgagaagtggatgtaccagtagaatgggttggctttgctatccctgatgagtttgtggtgggatatggtattgattatgcacagcattatcgtaatttagattacattgcgaaagtgattattgatgaataagaagtgaaactttcaattaaattaaccgcttgttgatataaacttcaagcggtttttaatttctaattgggctttagtatctaggagagtttatggggaaaaaaatattatttgtttatttggcgatgtgtttatctgcttgggctacgcagtctcagtcatctccagaaattgagaaactaaaattacaatggcagaacgagcaacaaaatatctaccgtcaattggaaaagcaaagagtaaattttttgctgcttgagactttattacgagagatggaacgagagggaaaattttctaatgcgatatttgagcgagtggtgcatttagaggcaatgttgcttgattaccctctgattgaagagataaaatgggctatattaaatactaaactaaaattgaacgctatttcgcaagaagaaattctgcactttatcaagcaatatccgcatatcgcaaaacgcaataagctggaacagttcccgatagaaatgtggtacaaacagcaaaaatggtcagagcttctagcctatagcgacaaagtcggtgagctaagcgttgctaatcaatgtcgagtgtgggcggctcaatatcaaagccaagcagataaattacagttaaatccagaagcggcacaagcaaataatcaggctcaacctttatcgcctgagttagctcagctgttagcaaagtttgatgatttttggatcaataacggctcattgccctctgactgtgcgaacttggaagccttctggcgagatcaggggttaaaaaccgaagataaagtgaagcaaaaagcggtcaaattatggataacaaatgcaaaagcggagttaagccagttagcgttaaataaccaagatgtcgagttaggaaaatggcttgccgatttacaaaaactcttgtctgagccgaattatttgcaacattttattgcgaaacaaccgcttaacgatctcaataaacagcttgtattgcacgctttccccaaacttctcaaaacattgcctgaacaaatgcaaaatgtggattttgccccatatcaaacttgggcagagcagtggcaacttagcgaaaatcaagtacgtgaatggaaaatccagtttctacaacgcttttttgataacacaacaccccagttccagcagtggcgagatgcacagttagccgaattaaaagaggatagtttaaccgaacgccgcttacgaatggcgatctggcagaaaagcgatttaaatagatggttagtgctattaagcccagaaaccagagccaaagcggaatggcgttattggttagccaaaagccagccggcacaacaagcggctattttccagcaacttgccacagagcgaggattttatcctatgttggcggctcaagcccttggacagccttatcagctcgtattgccagcgattaacaaattaacagaacaacaaacccttaaatttaagcctcagcttaaccgcattgcagagttaagggcgttaaaacggctgagtgctgccaaaattgtttgggtagatttactgcaagcggcgagttttgacgaaaaaattgcattgagtaactttgctttgcaacaagattggtttgatttagccgttgaaggaaccattcaggcaaaagcgtgggattatttatcgctacgtctgccaaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattcagattggtttgaactcaatttacagcataaaaaaatcactaaaacctttgcaatggcaatcgctcgccaagagagtgcgtggaatgctcaagcacgttcgcacgcaaatgcaatagggttaatgcagttattgccaaccacagcaagccaaacagccaaagcaaatcaactgagctatacaggggaaaaagatttactcgacccttttaaaaacattatgttggggacagcccatttagcagagttaaatgaaacctacccaaataaccgaattttaattgcggcggcatataacgcagggcctcaccgagtgaaccgttggttagaacgtgcaaatggcactttggcgatggacgaatttattgcctccattccttttgtagaaacaaggggatatgtgcaaaatgtattagcttacgactattattatcagtttttgtataatgaaacattagttttatttacgagagatgaaagagaaagaagatattaattctttaatgaataaaaagaataatgaaaagttttattggaatactttaactaaagtctattttacatatgagaaacaatagcgtgataatgttacgaaaatccttttttttacccctgtttttaacgggctgcgtgatggtaccaccgcaattttcgatacctgaacaggttaattttcaaggtaaaacctaccaaaaagtgacccaaaatcagcttgatgaaatgcaacaatcgctttttttactcaaagaaagctcaaaagatccgaataactggcaacaaggcattttgttgtttactgataaaaacagccaacaaaaaagccttgctgatagggtggagttacgtcagcaaactttcgctaaacagcctgataccaaagcgaaagtggcgattgtcggtgacgagctacaaagccaagtgctttatccacccacagagcgtttcaatgattatcagctggaagtcacccgtgggcaaaattctcagtgtggttacagccaaatgcagttctcggacaagcggtcagtttctgcaaaaaatttgcaaaatccaaccgcttatattaaagaacttcaacaaatggcgtggcagttttcgcaattagcgtggcaaattgagtgcaaataatggaaaaacagtataaccaatatgtaaaacgggcggcgaactttgcagtaattgtcgctgccaccttaattattgcaaaggcgtttgcgtggtggcagacaggatcgatggcgattttagcggcgatgacggactcgttagtggatttgttcgcctctttaaccaatatgctcgtgttacgttttgctttacagccagccgatgatgatcatactttcggacacggcaaagcggaatcccttgccgcccttgctcaaagtgcctttatcactggttctgcaacattcttattgctacaaggtattcaacgtttaaccgaaccacaattagtacaaagcagtgaattaggcgttgcgattagcttgttctccattgttctcactgcagcattagtttggtatcagaaaaaagtggtaaagctcacccaaagcccagcgattgaggccgattcgttacattatcagacggatctctatatgaatgcggcaattcttgtggcaatgattttaaatatctacggcgtaatttatgccgatgccgtatttgctattggcattgccctttatattctgtttaatgctgccaaaatgtgttgggaagcggtgcaatccttgttggataaagccttacctcaagaagaagtcgatcaaatttgggcgattgctttgcaacaccctcgcattatcggcatacacgatgtcaaaactcgcagagcaggggcgattcgctttattcagctacatttagaactggacgatcatctgcctttggttgtggcacacgatattaccgacagccttgaacagaaaatattggcagcctttccccattcggaagtgattatccaccaagagccgacgacgattgtcaaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaccaaatgtattgagccattgcataagtgattgaaatccttctggattatttttaaacactttatgcttatgtttgccattttgtaatttaatggcaacatcaaatttagctttggcaatatcaatgccaacgtaatataatgggttatccatttgacctccaaaccttgtgaatgcgggctacggaaaacgtgcctgagataccattcggggtgatagtggatgagaaagtaggcttatatctacactacgtgcttaatggcacaaggggcaaagcaactctactttctctataaccccattatgaaggtactcgtaatggggttttcttttgcccatattctaatacaaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaccaagccttagcccaagcggaagaagccggcgtggtttttgagtattaagcggtgtaatttgaatgttttttcggtattatgtatcagctacgtaaatatctcagtccttttgaaccgagggctgagagtaatttgttgtctgaatataaatacatacaaagttaaccccgatgaaaaccgctcaactttaccgttattccttacctgttgaaacaggcattatcttacgtaaccgccgtttaaaacaacgagatggtttgattattcatttgaaacatgctgacaaagaaggctggggggaaatcgccccattgcctgaatttagccaagaaaccttagcagaggcggaaattgcagttcgccaatggattgaaaagtggctaaatcatcaagacgattctttaacatcctatccaccgtccgttgcatttggggtcagctgtgccttagcagaactcaatgaaacattaagcgaagaagccaactttcaaactgtgccactctgttatggcgacccagatgaactttatgcagaattgaaccaaatgcaaggggaaaaaatcgccaaaattaaagtagggttatatgaagctaatcgagatgggcttattgcggatatgtttttagaagcgattcccgatttaaaattgcggcttgatgctaatcgctcatggacgctagaaaaggcgttgctttttgcaagtaaaattgcccctgaacgcaaaaagcgcattcagtttttagaggaaccctgcaaaactccagaactttcacgtcagtttgctgaacagacagggataaatatcgcttgggatgaaacagtacgagagcctgattttttggtaaaaaaagagccaaatctaaccgctattgtgattaagccaacgctcgttggttcccttgaaaaatgtatttcactcattgaacaggctcatcagcaaggtttaattgccgtgataagttcaagtattgaatctagtcttgggcttactcaactggctcgctttgcgactcaatatactccaaacactttggctggtttagatactttagatttaatgaaagtacagttattgcgggagtggaataattcaactttaccgatagtgcatttaaatagcccgtatatttggggattagacgacaatgttaagtaggctatgtgataatgattaaatagcagcctgttcaagagacgatgcggtgtaaaatatcccatctaaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtgggaagtggtttaggtttgaaagatgatgctgaatcaaataaaacggcacttacccctacagatgcacaaaaagctattgctggtgataacaaagacggtaaaggcggcttattggctcaaacgggtaatgcgttaaataatgtagcgacagtgaaagatttacaagccattgcacaagcgggcttagacttgacgggtaacaacgccgataccactgtacatcgtccattgggtacgaagttaaccgttgagggtgaaggcaaatggaatggtaaggactcagcggctaataacctttatgtggaagcgcaagaggcagataacaaacttgttgtgaaaatgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggatttaacgaacttaaattctgtgactttaggcactgcgacaatgactggtgataagaatacaatcaaccttactggtgcaggagagaaagtcgaggaagagtttgttaaatgggacccagtgactaaacaacctattcgtgatgagaatggcaatctccagaaatataaagagaaagttgatcctcgtgtgaaactgagtggtattgctgatggtgatatttcaccaaatagtactgatgcagtgaatggtcgccaagtttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagttctgttgctttaggtaacggggctacagctggagagcaaggcgtggctattggtcacggtgctgtggcgtcaggtaaacaatctatttcgattggtaccggcaatgtggtgagtggtaataactcaggtgctattggtgaccctaatacaattaaagcagatcgctcttatgcattaggtaataataaccaagtgaatgcaggtcaatctgatgtgtttgttgtcggtaacaacgtgaaaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgggtttagtggtaggtttgaataaatttttgataggcattcaaaaacatttcaaaatcttctaatccacaaaaagcgatactttcttcatcatagaaactaaagccgttttcgacatcttcgatttcttcaaatgtcatatccagattatttgctttcaccatcacttcttcaatgttgatataaaggctatattctttaccttcaaaaatccattcgtggttttgatctttggtttggcgacaatgctcaatttcggcaaaaatggcggttaactcttttggatttggcacaatctcggtatttaaccaacgagcaaatgcctcgtgatccattgaacatttggcaataacgccgtgcatggtatgtgtaaattggtattccatcattttctcctttcaaacaagcggtcggattcgtttgtttttttgcaaaatattataacgaagtggctgcttgcaactacaacttaacctttcttcaaaatctcttttaaaaatcttgccgtatgggatttcttatcttttgccacctcttcaggcgtaccttcggcgataatctgtccgccaccgctaccgccttcaggacctagatcgacaatccagtctgccgttttgatcacatctaagttatgctcgatcaccacaatggtatttccttgatcacgcaagcggtgcaatacggtcaataattgtttaatgtcggcgaagtgtaatcctgtcgttggctcatcaagaatatagagggttttgcccgtgtcacgtttggataattccgctgccagtttcacccgctgagcttcgccacctgacagggtggtagaagattgccctaaacggatataggataagcctacgtctattaaagtttgtagcttacgtgcaatcatcggcacggcatcaaaaaactcacgagcttcttccacagtcatatctaacacttgatgaatggttttgcctttatagcgaatttcaagggtttcacggttatagcgtttgcctttacagtggtcgcacggcacatatacatcaggtaagaagtgcatttcaactttgatcaccccgtcaccttgacaggcttcacaacgtccgccacgtacgttaaagctgaaacgcccgacagtatagccccttgctcttgcttcttgtgtaccagcaaagagttcacgaatcggggtaaataaacctgtataagtcgcagggtttgaacgtggcgtacgtccaatcggactttgattgatgtcgattactttgtcaaaatgtgccaagccatcaatgctcttataaggggcgacatcgctgttttctgcacgatttaacgcattttgagcaatcgggaataaggtgtcgttaattaaggtagatttgcccgaccccgatacccctgtaatacaagtaaacaagccaacaggaatagctaaatcgacttcttttaagttattaccgcttgctccttttaacaccagctgtttgctttcatctcgtggggtacgctgtttcgggatctcgattttttccttacccgataagaatttacccgtaatcgatgcttcattttgcataatttcttgagctgtgccttgagcaataatctgaccgccgtgtacccctgcccctggtccaatatcgacaatatgatctgccaccataatcgcatcttcatcgtgttcaaccacaatcacggtattacccaaattccgaagatgaataagagtgttcaataaacgttcgttatctcgctgatgcaagccaatagacggttcatcaagcacatacatcacccccactaacccagcaccgatttggctggcaaggcgaatacgttgggcttcaccgcctgataaggtttctgccgaacgagagagcgaaaggtagttcaacccaacattgacaaggaaagacaaacgctcacggatctctttgagaattttttccgcaatttgtgctttctgcccagatagatgtaagccttcaaaaaattctaaggcttcgccgatacttttttccgacaccatcggcaagttggttttctctaaaaagacataacgggcttcacgacgtaaacgagagccttcacaatcggtacaaacacgattattaatatatttagccagctcttcacgcactgcatttgactcggtttccttataccgacgagccatattattcagcaccccttcaaaagtgtgaactcgcttaacgctatcaccccgatcattcacatagacaaattcaatttcatcttttgaaccatttaaaatgatgttttgaattttcttcggtaactgattaaacggcatttcaatatcaaaatcataatgtttcgccaccgatttcaacaaaccgaaatagtagaaactacggcgatcccaacccttaatcgcaccgcttgctaaagacacatcagggttttgcaccactttacgttcatcaaaatattgctgaactcccaaaccatcacaagttgggcaagctccggccggattattaaacgagaaaagacgtggttctagttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgacgaaaacactaactcttccgcatttggatcgtccatatcggcaataatcgccgttgagccggagagttctaatgccgtttcaaaggactccgctaaacgggtcgcaatatcgctacgcactttaaaacgatcaatcaccacttcaatcgtatgttttttctgcaactctaatttgggcggatcggacagatcacaaatttccccatcaattctggcacggatataaccattagcggtcagattttctaataattttgcgtgttcacctttacgatctttcaccacaggagaaagcaacatcaaacgcttaccttcaggctcttccagcactctatccaccatttgcgaaattgtctgagccgctaacggcacatcgtgatcaggacagcgaggctcgcccacacgggcaaacaacaaacgcaaataatcgtggatttccgtcaccgtccctaccgtagaacgaggattgtgtgaggtagatttctgctcaattgaaatcgcaggggaaagcccttcaatgtgatcgacatcaggcttttccattaaagacaagaactgacgagcataagcggataaactttccacataacgacgttgcccttcagcataaagagtatcaaaagccaaagacgatttgcctgaccctgacaaccctgtaatcacaataaatttatctctcggaagaaccaaattcacgttttttaaattgtgggttctcgccccacgaatatcaatatgttgcataactgccttctaaacaaatgtaaagcaaaaatttccgaattttcgattattatcgcataaattgattaactgtacaaaatatcagttttagtagatgattttttttttattttcaggcaaaataactcttaatgttttacaatattatgtacaaaaatacataactattatttttgaactaatgaggtagggacacactgcgtgtgtccccgataaatacaaacatatagtttcggacacacgcagtgtgtccctacgcaaaactacatttaaccaacacaatttatttaagaggatttgatatggcaggtgtaaataaagtaattattgtcggcaatctcggtaatgacccagatatgcgtacaatgccaaacggcgatgcggttgcaacattaagcgtagcaaccagtgaaagttggaacgataaaatgacaggcgaacgccgtgaggtcaccgaatggcaccgtatcgttttcttccgccgtcaagcagaagtcgcaggacaatacttacgcaaaggttcaaaagtttatgtagaaggcaagctcaaaacacgcaaatggcaagatcaaaacggtcaagatcgttacaccacagaaattcaaggcgatgtactccaaatgctagatagccgtagcagtggcggtgattttggcggaaatcaaggtggtggctggaaccaagcacctgctccgcaaaactataatcaaggctacaacaacgataattacgcacaaaataactttggcaatgctcaaccacaaaccgcaaaagcaccagcaaaaccagcaccgcaagcggaaccgccaatggataattttgatgatgatattccgttctaaaatattatattagagatgaaagcccagcagtttgctgggttttttattatagctaggactgctttaatccccctgaaaacattaagatgatttaactaggttattttgtaattggaattctgcacgtatttgaaattagtttcaattataattgaaactttatttatttaagagtaaagtattaattataaatgaaagggggtagtgtgaagaaagatttagtttatcgtcagaaataccttgaaacggtgcgtccgtttatgggaaaacgtctaataaaagtgttcactgggcagcgccgtgtggggaaaagttatttgctgtttcagattatgcaagagattcaaacggcggatgaaaatgcccacattatttatatcaacaaagaagacttggcatttagccacattacaaccgctgaaaacctaaatgattttgtgcaggagcagaaaaagagcggtcaaaaaaattacatttttatcgatgaaattcaagaaattacagattttgaacaagcattgcgttcgcttttattagatgatgaattggatttgtattgcacgggcagtaatgctcatttgctttcacgtgatattgcgggcagcctgagtgggcgggccattgaaattaatgtccactccctttcctattttgaatttcttgaatttatgaaactggacgatagcgataaatcaatgtcgctgtttttgaaatacggcggtctgccttatttgaaagacttgcccttgcaagacaatatcgtatttgagtatttacgcaatatttattccaccattgcgattcgggatattgtgaaccgctatgcgttacgaaatgtgcaatttttagagcaacttacgcaatttttagcaagcaatatcggcaatctgttttccgccaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaatctgttttccgccaaaaaaatctctgattttttaaaatcacagaaaattactacttcaagcacgcaggtgcaaaattatgcggaataccttgccaatgcctttttgatccacaaagtgccacgctatgatattgaaggtaaacggatttttgagattggcgaaaaatactattttgaagatttaggtttgcgaaacgccctgattggctatcgagtgcaagaccgtggcaaattgctcgaaaactgcatttttaatcatcttcaaatcgcaggttacgatgtcaaaatcggtggtttaaatagccaagaaattgacttcgtagcagagaaaaatggcgaacgcatttatgtgcaagccacactcacgattaacgaagaaaaaacgctcgaacgagaatttggcaacctgctcaaaattcaagacaactaccccaaatatgtggtgacgatggatgaatttgagggtaatacctttgagggagtgcagtgcttgagtttgagggagtttttgaaggagattttggggcaaatgtgatttgcccctacgatgaaatgtttgtgtaattgctacataaaaatcaatccaaccccttctccttcaaccacttcgccaaatacgtcccagaaagaaactggaaatccgtttaaatatgcttcaccacccagtccaaattgatcgatacgttctgcaatttttccttgataacttcccgcttgcactaagccggataagtcacctttgacatcaactaggaatacgggaacgccatcattgctaaaagtttcagcaagttttcgcaatgtaacagttttccctgttcctgttgctcctgcaattaaaccgtggcggtttgccatcttggctgttaaagaaatgggattgcctgacttgctgtgtgcaatggtgtaattaattttttctccttatttatatttcttgccttgtggtgttcttgttttggctttttgtggctttggcaatgctaaaagcacttcactgtcgtattgacttacggggatagcgtgtccgatatattcttcaatggctggtagatttacggcataacgttcacaagcaaagctgatcgaaactccactttcccctgctcgtcctgttcttcctatacggtgaacataatcctcacggtcgtctggtaaatcatagttaaagacgtgtgtcacatcaggaatatgtaaacctcgagcagctacatctgttgccactaaaatatctaattccccttgcgtaaagctatccaataatgccaagcgttttttctgtggtatatcgcctgttagcaagccaactcgatgtccgtctgcactgaggtagctccaaatttcttcgcatttatgtttagtattggcaaacacaatgcaacgatcaggccactcttcttccattaatgttagaagtaatgccattttatcttcattagaagggtagaacagttcctctttaatccgatgccctgtgcgttgtagtggctcaatttccacatattctgcattgtgcatatcttcaaatgccagttcacgcacacgatgagagagcgttgcagagaacaacattgttaaacgctcttcgggtttcggacattttcgcattaaatagcgaatatctttgataaaaccgagatcgaacattcgatccgcttcatctaacaccacgacttgaattttatcgagatcaataatgccttgtttgacataatcaatcacccgtcctgttgtgccgattaaaatatcaactccacgctcaatctcttgtagttgtttgtcgtagccgtcaccaccataggcaagagctaaacgcagatccgcatactgcgttaaaattgatgcatcagaggcaatttgtaccgcaagttcacgggttggtgcaagaattaaagcacgaggttgattgtgtttggttggaatatcgtgatttaatagatgatgaaaggtcgccacgatgaatgcaagggttttccctgttcctgtttgggcttgccctgcaatatcttgtccgatcagcgtataaggtaacgttttcgcttgaatgggtgtacaaaattcaaagcctttgctatcaagagcagccaagacactgtcgtgaatcggaaaatcaataaaacgttgttcagtaaggtgtttagacattatgttctcctataagcaacaagcggtaaattttgagcagaacgttgcaacatacaacaagtgctatgcaaataacggctgaatattaaaacttgggcgttgttcaagctgccaaagatcgtattgggattgtaaaccaagccataattctgggctagtttttaataattggcttaatctaagagccatttcaggtgaaattgcagctttgccatttaaaatacgagaaagcgtgacacgagtgacacctaaacgtttagccacttctgtgacattatatccttcaatatattctcttaaaataagccctgggtgagctggattgtacattttcattgatagctccttaatgataatcttgatagtccacgacttcagcgtgaccattttgaaatttaaaagttaaacgccaatttccacttaccttgatagaccaatgcccagctagattaccttgtaattgatgtaaattccagctaggtgcattcatatctaaagcactttttgcttggtttagagtggctaattgaaaagcaagtttactagcgtgatttgcctgaatacctgcagttgatcctgtttcaaaaaataatttcaatcctttatgcttaaatgaaataatcatctgccctcctgattgtatcgctaaactatacagaaaaagaggtgggatgtaaagcaataggatacatcactcccataaattcccattgttctcttattgaaaggctttataataaaagccttatttatttcaaatcaggaaaatcattatgtcagcaaacaccatcaatcttaaaaatcgccattttttacgtctaatggatttcaccccaaatgaaattcaatacctgctagatttatctgcaaaattaaaagcagacaaaaaagcaggtcgagaagtcccaacaatgcaaggcaaaaatatcgcattgatctttgaaaaaagctcaactcgcacacgttgtgcctttgaagttgctgctttcgatcagggggcgaatgtgagctatattggacctagcggatcgcagattggacataaagagtcaatgaaagataccgctcgtgtactgggtagaatgtatgacggtattcaataccgtggttatggacaagtgttagttcaaacattagcagattattctggtgtacctgtttggaacggtttaaccgatgaatttcacccaactcaaattcttgccgatttccttacgatgatcgaacattcaaataagccacttaatcaaatcaaactcgcttatttaggtgatgcgcgtaacaatatgggaaattcctttgttgagggggctgcattaatgggggtggatttacgtttagttgcacctaaacagttctttcctgaacaaacattattagacgaagtcgcagaaatggctacgaaaacaggagcaaaaatcacctgtacggaagatgttgcagaaggggttaaaggtgttgacttcgtctatacggacgtttgggtatcaatgggtgaaccagaatccacttgggaagctcgtatcaatttaatgaagccttatcaagtgaatgctgaattgatgaaattaacgggcaatccaaatgtaaaattcttacattgtctacccgctttccacgatgaccaaacccttgtaggtaaagaaattgcagaaaaatatggaatgaacggcttagaagtaacggatgaagtatttgaatccgaagcctctattgtttttgatgaagcagaaaatcgtatgcatacgattaaagcggtgatggtggcgacattggcagggtagagtaggtgcgggatttacttgcatctttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgggggaagaatttatggctgtgtaaacgaataacaccatttaccctctaacaaaagggtgttttaatgctaacgcatgcgtggtttcgtgtaaaagggtagaaattccttgattttctggggtgagcttgtcagaaaatttcaaggcattcagtcttagttttagtttgcttcttgatatttttattacaatcatcagaaaaaactactatctaaagtcaaaaaaactgcgtagaatatggataaatcaattacgcaaacgattacttataggagaaaccaatgttaagacgtgatatgaatatcgcagattatgatccagaattatggcaagctattcaaggcgaaaatcgtcgtcaagaagagcatattgaacttattgcttctgaaaactatgcaagtcctcgtgtgatggaagctcagggttcacaatttaccaacaaatacgcagaaggttatcctggtaaacgttattatggcggctgtgaatatgcagatattgtagagcagttagcgattgaacgtgcgaaagagttattcggtgcagattatgccaacgtacaaccgcattcaggctctcaggcaaatgcggcagtttatggtgcattattgatgccaggtgatactattttaggtatgagccttgcacatggtggacacttaactcacggtgcttcagttagtttctcaggaaaagtgtatcacgcagaacaatacggtatcactgctgaaggggttattgactatgatgcactacgtaaacaggctcacgaagttaaaccaaaaatgattgtaggtggcttctctgcttattctcaaattgttgattgggcgaaaatgcgtgaaattgcagatgaagtcggcgcttatttattcgtcgatatggctcacgttgcaggtttaattgcagcaggtgtttatccaagcccactccctcacgcacacgttgtaacaacgacaacacataaaactcttgcaggtcctcgtggtggtttaattctttccaatgcgaaagatgaagaaatctataaaaaactacaaaatgcggtattccctcgtgaacaaggtggcccattagttcacattattgctgcaaaagcagtttgctttaaagaagcattagagcctgagtataaggtttatcagcaacaagtggtgaaaaatgcaaaagccatggtggaagtatttaaacaacgtggctataacgttgtttcaaatggtacagaaaaccacttattccttgttgatttagtgagccacggtttaacgggtaaagcggcagatatagctttaggtaaagcaaatattactgttaataaaaatgcagtaccgaacgatccacaaaaaccattcattacttctggtattcgtgttggtactccatctgtaactcgtcgtggttttaaagaggctgaagtacgggaacttgcaggttggatgtgcgatgtattagataacatcggtaaggataacgaagctgcggtaattgaagtgactaaagtgaaagttttggatatttgtaaacgtctacctgtttatccataaaattaacaaatagatttgttgtgttatcctcttgtcattatttgttttagttacaatattgacaaggggataatttatttgaggataacatattgaatcctttaaattttattatgaaaaaccatatcctaaccatcagtcagctcaattactccgttaaacagatgcttgaagtcgaatttggcagtgtttggcttatcggcgagatttcaaacttttcgcaacctgtttctgggcattggtatttaaccctgaaagacgaacaagcacaggtgcgttgtgcaatgtttcgtatgaaaaatatgcgagtgaatttccgtccgcaaaatggaatgcaagtgttggtaagagcgaatgttagcctgtatgaaccacggggtgactatcaagtgatcattgaaacaatgcagccggctggcgatggcttgttacaacagcaatttgaacagcttaaaatgaaattggctgggttagggttatttgctcaagaacataaaaagcctattcctacgttcgtcaaacgtgttggcattgtgacatcatcaagtggtgcagcgttgcaagatattttgcatattttacaacgccgtgacccaactcttgaagtggtgatttatccgaccttagtgcaaggcaaagaagcgacagctgatattgtgaagatgatcgagctggcaaaccgccgtcaagagtgtgatgtgctgattgtcggccgtggcggtggctcgttggaagatttatggtgctttaatgaagaagcggtcgcttgggcgatttatcactctcagatcccagttatcagtgccgttggacacgaaaccgatgtgactattgcagattttgtggcagatttgcgtgcgccaacgccgtcggctgcggcagagttggtcagccgtgatcagcaagagttgttacgacagttacaacatcacgcagataaagtgaatttagcctttgatcgcttatggagtgaaaaattagctcgatttgaccgcttgcaacttcgtttacaggcgcaacacccacagcgtcaattacagcaacgtgtccaagagcttttgcacttagaaaaacagctgaaacagcagatggaacagctattgttgcgtaaacaacagcgttggaaaaatacgctacaacgaatggaacgaaatccgcttccttaccgtatttcagcccaaacacaacatttgcacaagctagagcaacgtttaagctatgccattgagaagaatatcagccaacgtcgccagcaatttcaaaccctttgcacgcagttagacggcttaagcccgcttgctattttagcaagaggctactccgtaacacaaaaccaacaaggcaaagcactgctatccactcaggatatttcaatcggtgaaacgatagtcactcgtttagcacagggaaatgtggtaagtcaggtggtgggtattctctagaatgtattaaggggaataccattccccccaatcctaatctacaatttcaacttcaacattaccacttagccctcgaagttgcgtgccttttcttgctcgttcgccacgataatgttcaatatctgttggttttagcgtaattttacgtttacctgaaacgaaaaccagcgaacttgttgggttgattataagtaatcgagaaagtagctctgctcgttctttcgcagcttgtgcagaaatgttgatgatcttatttcccttgcctttagataactcaggcaattcagaaactgggaagattaatactcgccctgtattgctcattgccactaacagattttcttccccctcttttaacaactgcggtggtagcacttttgcattttccgttaaggaaataaccgctttccctgccttgttgcgagaaaccagatcttcaaattggcaaataaagccatagcccgaatccgaagccattagtaccttacgactttcctcagccattagcacacattgcaccgttgccccatcaggtaaactgattttgcccgtaataggttcaccttgcgaacgagcggaaggcaggctaagaggatcaagagcatagctacgccctgtgctgtcaataaagacaactggctgattgctcttaccataagcgtgggcaaggtagctatcgccagctttgtaacttaggttctgcacatcaatatcgtgccctttagcacaacgtacccagcctttttcggaaagaattaccgtcacaggctctgttggtgttaaatcgctttctgaaatcgctttcgcttcagcacgctctacaagtggtgagcggcgagggctggcaaaggctttggcatcggcttcaatctctttcttaatcaagttatttaaacgacgctctgaacctaagatcccttgcaaatgttcccgttcttcttcaagtttctgctgttctgcttttaactcgtgttcttccagttttgccaaatgacgtaatcgtaagtttagaatggcttcggcttgctcatcgcttaattgaaaacgtgcaattaattcagctttgggattatcttcattgcgaataatctcaatcacttcatcaagattaaggaacgcaatcatcaagccctctaaaatatgtaaacggctgatgattttatccaagcggaaatttaaacgacgtgtgaccgttgttctacggaatgctaaccactcagtaagaatggtcagtaaatttttcaccgcaggtttaccatcaagcccaatcatattcatattgatacggtagcttttttcaagatcagtggtagcaaacagatgatccattaagccatcataatcaatacggttagaacgtggttctagcacaatgcggatagggttttcgtgatcagactcatctcgaatatcatcaaccatcggcaattttttatttcgcatttgcgtggcgatctgttcaatcactttagatggcgaggcttggtgaggtaaggcattgataacaatattattctcttctcgtttccataccgctcgcattttaatagagcctctaccttgctcataaatctttgcaatttctgagcgcggtgtaataatttcagcttctgttgggtaatcagggccttgaaccacgtccaaaatatcgctaagactagcggttggattatccaataattttactgaagctgccgctaactcgttaatattatgaggcggaatatctgtcgccataccaacagcaatacctgttgtgccatttaacaaaatatgaggtaaacgagctggaagatatttaggctcttctaatgaaccatcaaagtttggttgataatcaaccgtaccctgtcctaactcccccaatagaatttcagccattttggagagttttgattcggtataacgcattgcagcaaaggatttaggatcgtctggcgctccccagtttccttgtccatcaattaatggatagcgataagagaacggctgtgccatcaaaaccattgcttcataacaggcactatcaccgtgcgggtgaaatttacctagcacatcaccgacagtacgtgcagattttttatattttgctgcagcatttaagccaagctcagacatcgcataaataatacgacgttgcacaggttttagaccgtcgccaataaaaggcaaagcacgatccataatgacatacattgagtaattgagataagcgtcttccgtaaaacgcttaatcggcatttgttcaacgccttcgtaattgatttcagtggtcattggaatataaatactattgaaaaataaaagagcttatcttgacaattctctcttatttgtagagaactgtctacttaattagtaaagtgttgcacatgcgagatgttcaagctatttttgataaagaagagatattctcaaccaaagctcgtcgaacacaattaaagaaaaatataaaacaaaaatcaatagaagattatattgattcaaatacagaaaaagtagaagaaaatgtcaccacttcagaatctacagatattgatgaagtaaaaaagaatgaatcttctgtatcctctacggaagtagttgaaaatacaactttggtgtcagatgttgctgctcagagtagtagtgttatttctaatttagcttatctcggtggagggattttaggtgttggagcggttgtagcagcaataaatcaaggtggaaaagggtctttattaaatataataaagggactggtgaattaacctattctactggcggtaatgacatcatttttgctcagttgactactcatttagaattgtccgaaaaacactttggtattatttgatgagaagtaagggggagactggattagaaagcagtcaccccctttgatttttattaaattaggagcatttttatataaacttaaccatcgccctgaccacagcttctggtttttctgcgtgaacccaatggtctgcaccgctaacaataaaggattttgcttgtgggaattgagctaagatggtttgggtgtctttttcttgtaagtaatccgataacgcccctttgataaagagagtaggtttatccacaaaaacattttgccaatccatgagattggggtagttttgttttaaacccgatagattaaatttaaagaattctgggctttgtggatcgaatgatttcagcataaattgttgtatgccttcatcttgaataccttttgcaattgctgttttggcctcttggcggttagctggtttggtagctttaaccgcaaaaagtcctgcaaaaatgtcgtcgtggcggttgaggtgataagcaacgggggcaatgtcaatgatgattagttttgccacaagctcaggggcgatgttggctaacatcattgctgtttttcctcccattgaatgcccaacgagaataacattgttaagttgtaagtggttgagtagatctcgcagatcttctgccattaaggtatagttcatttcatcactgtggaaagattgcccgtgattgcgtaagtcgatgcggagtagattaaactgttccgcaaaggctctggcaatcacgcctaagttattcatatcaccaaataaaccgtgaataaagaccattgtttgtggtgatgaagtcgctgagttggttgctgtttgaaattggtgatgaagaaacattttttccgccataatttaattaaaatttattcaattatcgtgtttagatcctgttaaaaagatcggaaatgcgtataatgcctagaattttacagtaatcaagttatttaggggacaagatgaaaacaatcgaagttgatgatgaattataccactatattgcaagcagaactcaggctattggggaaagtgcgtcagatattttacgtcgtttactccgtttaccagcatctccccaaccttttgtacttgtgcaagagaatatgatcaatgaattgaaagatcttgcaaagctgcctaagcaaaagaaacaactccatcaacaagataaggtgattaagcaagttgaatttgtgttggcttcgagcctttttaacaatgaaacaaaaggcgtaaatcgctttttatacttgttgtctgccttgtataaagcagatcctgagggcttttctcatgcgacggaaaatgtgcagggcagtgagcgaatttattttgctcgtgatgaacaaactattcttgcgacgggctcgagtgttaaagcgaagcaaattccagagtcgccattttgggtgattacgaataataatacggaacgaaaagggattattttgtgtgcattaatgaatgcaatggaattacctgaagagttagttgctcgtattaaagctcaattcaattaatttatgtcaagggtagtatttccgacattccccacaatatattgggcagaaaaacaggctcaagatattgctattgtttgggatagaggaaatgctaccttgttttcttacttaccccgtcaaatttcgtggcaacagttgcaactgttgattgaacaagcggtgagattgcttgagcagttagcattgccgaatagcttggtggcttattcaggttctcaccgtttaatcggtttgctctgttattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgtgttggcaagtggcagaaagatcttaacgcttaatcctgcaatgagcgagatccaacgccaacagatattgcaacaaaaccaagtatctattttgctgaccgatcaggatttttattctctagataggggttttcagttatctagaaatcaagacaatggcttattttctttcgataaaccagccacttttacccttacgtcaggttcatcaggcaatcccaaagcggtagtgcattctattgctcaacatcttgccaatgcaatcagtgtctgtgattttgttcaatttgatcgccattgttcttggttgttaagtttgcctctttttcacgtttcggggcaggggattgtttggcgttggttatcgcaaggggcaatcctttatctgacggaagataaagcggaattttggcaaatgttatcgcaagtcagccacgcttctttagtaccaacacaattacagcgttatttagcttggcttggtgaaaagttagtatcacagcatattttattaggtggctcggcaattccggcagatttaattgaacaagctcaacagcatcagatcacaacttatgcaggctatggaatgacagaaatggcatcgaccatttgtgctgttaaaaatgagagtgataatgttggcaaaccgttagcaaatcgagaagctaccctcgtagagggggaaatttgggtaaaagggcagagccttgcgttaggctattggcaacaaggtaaaattgttgccttacacaatgctcaaggctggtttgcgacaaaagataaagggcgttggaataatggcaaattggaagtgctagggcgattagataatatgtttatttcgggcggggaaaatattcagcccgaagaagtggaaaaggcgctacaaaaatatccgcttgtaaaacaagtgtttgttgtgccagttgccgatcaagaatttggcgaacgtcctgtggcgttagtggcttttagcgaacctttttcaatacaagcggtcaatctgttgaaatcttttgcaatgcaacgattagaaaaattcaaacagccgattgcttatttccctttggaagatgagatagggcaatcaaatggcattaagatgtctagaacccatttaaaagcgtatatcgccaacaagttgagagaaaaaaatgtgtaaaaaatcattttggcttgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttatgtttatcttttttcacggcgacggttcagtctgcggtggaagattttgtgtctgcggaagatttgaaaacgcagttagaagcaataaaaaccaatccttctgaacaagtaacagaagcactcaaaaacattgaagaagccttgttattcattgagaaaaccaaaaatcaaaacagtgaattagaggcgttggaaaaaaaacttactaatgcaacggcaactttagataactataagaaaaatatcgataaattaactaaggagttaaacagtgatgttgaaatttccagcaaacttagtaatgaagagttagaaaaacgtttagacaatactcgtcaagagttaaacaatgttcaattgaccttgaatgaaacaaactctagtgcggtaacttatcgtacagcctcagaacaaacacgaaaacagattaccgaaaataatcaacaagcggataaattaacacgtttaaaacacaataaccaagcgagtaaatcgctgattgataaatacaatgctgaattaaaatacctagaggcaagcaataaatataatcaatttttagcccaaaacattgatctgttgatttcgctggaagaggcgaaacgtaatgaattaacgttaaaacagcaattgttacagaaacagcaggcaacgttacaggaagtcttaaatgccaagcgtttaaaagagtttgaggctcaagcaaaacaggctgaagaactaaaagctaacaataaagttgaaaatccgattattcacgatgagctttcattaaacaccgatttaagtcaatttttggttgaacagacacaaaaaaccaatacgttgtcacgggatagcctgcgtgctaaaaatgtactagacagtttgatacaaacccagcgaaacattgaagagcagatcagtgcattacaaggtactttggtgctatctcgtattattaatcagcaaaaacaatctttgccaacagatagcttaattaaagggctttccaaagatattgcaaatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaaatttacgggtagaaatttttgatttatcgcaaaaacgtgatgaactctataaccttaatagcgttatcgaaaaattagaaacgacccacaaaaccttatttgatgatgcggaacgcaaaaccttaacagacatcttaaaagagcgtgaaaaaattttagcggacttaattaaaacgcttaatatacagcttaatttgtctaatgagattgagcaaacacaaaagcagattatcaccatcagtgataccttgcaaaatcagctacaacaacaaagtttttgggttcaaagtaataacccgattgatttaacttggttagaaacctttccaaaacaagcaattgctgagatttcaacattaacggactatcttggctttgaaaatttggggcagaatttgccttcaaccctaacttttattgcgattttgttatccctttatggcttaattatttggaaaaaaacagacataaaacaccgcttggcaaacaccgcttggcaaccattggtagccatattaataccctaaaaaatgatagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaacagacataaaaccccgcttggcaaccattggtagccatattaataccctaaaaaatgatagccattggcatacgccagaagcgatgttttggacgatagtattagccctaccaagcggtttgatgtttttgacccttgcaactgtggcactttacctgttcgtgcctgatccgttattagcttcaacgtgggtgacagaggcttttggctattggttgttttttgctaccgttttatcgctattacgcccaaatgggttagcctatcgccatttcggtatgccacaggcaagtaatgaaattttccaacgcattattaagcagtctgtgtggattgtggtattgctcttagtttcttcgattttctctcaaattgaggtgatcgggtttactaatgatgtgatcggtcaagtcgtgacgatagttgctttagctttgtgtacttttgttgtacgccctctgttagatcggggtattcaagagcatgaaaatgctaaaacagaagatggtaaaaaacgcagtgtcagcctgtttaaacttttgcgttttgtgctgtttatcgtaccgcttaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgattgtgctgattgtgttaggttactactacacggcagtttatttaatcgaccacattattacgacttatttggtcgcattagtttgggtatttggacgctactttgcctatcgttctttaaccatttcttcacgtcgaatggcgtaccgtcgtttacagaaaaaacgggaaaaaatcagagaacagaatttagaacgtttagagcagggtgccaaagaggaagttaaagagaaaccagaggaaatcatcaagatttcaacggttaatgagcagattttccgtttagctgatttaatcggttgggtgattttgtttgtatcactttatgcgatttggtcagatttaatcagtattgcttattacctcaataacgtgattttatgggaaaacgttgaaactacctctaaaggcactgtggtagagtccgtcaccttattgaatattttacgttcaatactttatattaccgtcacctatgtgttagtgaaaaacttgaaagggattttagaagtgaccttcttctcacggattaaactatccaaaggaacaccacatacgatcactgcggtaatgacctatctgatggtcacgttcggtagtatttctgcctttacctcacttggtatttcgtggagcaaaatccagtggattttcaccgcattatctgtgggtcttggtttcggggtgcgtgaaatttttggtagttttgtatcaggtaccattttattatttgaacgcccaattcgcgttggtgataaagtaacggttggcaattttacaggggtgatcagccgtattcgcctacgttcaacaactttgattgatgatgataacaaagaagtggtactaccaaaccaagcctttgtgacagatagatttattaactggacctttaataacaccatcacacgcttgcagtttattttgaaaatcagcaccgaagcagatttatcactggttcgtcgtttgctaaaccaagctgcaagcgaagcgccaaaagtaatggacgaaccaagcccaagcattaatttgcaaagttttggtgatggttggatcgaacacgaatttaccgtatttgtaccggaattagacgatcgtgccgcaacacgcaatttcctctatcagcggatcacagaactctttaaccaacaccaaattaaaatgaccttcaatcaaatggaagtgcatttaaaaaatggtataaatagcgacatcaaatgatttgtaggggcaaatcatatttgccccaaacaatttttggaatatcagatttgtagggtggggttttagcccaccattttaaaacctattgattttatacccaacaataaaaataaggaaaacaaatggcaggcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcattggacaactttttaaagtcaccacattcggagaatcacacggcattgcattaggttgtattgtagatggcgttccccctaatatggaactcagtgaagccgatttacaacccgatttagatcgccgtaaacctggtacttctcgctataccacaccccgtcgagaagatgatgaagtccaaatcttatcgggcgtatttgaaggcaaaaccacaggtacaagtatcggcttaatcatcaaaaatggcgatcaacgttccaaagattacggcgatataatggacaaattccgcccaggacacgccgattatacctaccaacaaaaatacggtattcgtgattaccgtggtggcggacgatcttctgccagagaaactgcaatgcgtgtagcggcaggggcaatagcgaaaaaatatttaaaagagcagtttggcgtagaaattcgaggctacttatcacaaataggctcagtcaaaatcgacccacaaactgttgcaaatatcgaacagattgattggcaacaagttaatagtaacccgtttttctgcccagatcctgtggcagtggaacaatttgacgaattaatccgagagctgaaaaaagagggtaactctattggggcaaaattaaccgtgattgcagaaaatgtcccagttggtttaggtgaacccgtatttgaccgcttggacgcagatctagctcacgccttaatgtcgatcaatgcagtcaaaggtgttgaaattggtgatggttttgcagtcgttgaacagaagggtagtgaacatcgtgacgaaatgactccagaaggtttctgctcaaaccactcaggtggcattttaggtggaattagctcaggtcagccaatcatcgctcatattgccctaaaacctacttcaagtattaccgtacctggaaaaagtgtgaatgtacataatgaacccgtcgaagtagtcaccaaagggcgacacgacccttgcgttggtatccgtgctgtgccgattgcagaagcaatgatggcaattgtggtgttagatcatctattgcgatttaaggcacagtgtcgttaattgttaattaagaacgccatttggcgttcttaatataggacacgaagcgtcgtgtcctatatctccacaatcccctttaataaacagccctcataaatgcctaatttaattgcaatagaaggaatgagagggctgtcccaatcgtattggctggtgacaatatcaattcgtagttcattaagaagcaagttttgctgtagtttggtttgcagttgttcaaaaagtggttttttaatgcgtaatagcgatgagttcaacataattttttccgtagaaaatatgttgattaggttcatcagcatataagcaaggttgtcggtaagatgcgataaaatctgcattgcttgagggttttcggcttctacttgttcgcagaagtagttgattttatcttcaaggcaagtgtgttggtggtcaaaatagcggtcgatcaagttggctagggcagggaaagtcacttgattggtgagttgataacgttcgatttctgtccgttgttcagcgatttcatcactaagtgtactaaattttggcattatcattttatcaacattcattcgtttatgttcgtcttgatgaagtaatgcccctttgagtaatacacttaaattcacttgatcatcaagctgtaagaaaataacgttgtcattggcaattaaacttcctaaggttgcttccgctagaagccagagttgaaaatgctcgttgagtaaaatcggttgattaaagtgactatgtaacgtttcaaccagagggcaggagagaggctgttgccctaattgcgtgataattgtttttgtgtggtcaattttccccactacgctgatagaaatggcaagtaaagcttcgttggtaagtggtgtgttgagggagaaagtttgtatgcagtgcaggatatgctgatctaagctaagatattcgtcggaagtcaggctataatgttgttggtaaatgagcgtgccactgagatcgcaaagtgcaatagagagtttttgtggtgcaagggttaagcagagataacgccagtggaacggggagatagaaagccccactgcaggtctgcccctagacggcaaattttgtgaggttctctctaaaatcagtttatggtcaataagtattttcgtcagcactgtcattgatgcaggggcaaatcctgataatttcgctaagtcagtacgagaaatcagctcaaattgttcaactaaacggtaaaccgtgccgagatgttgatatttataatccgaagaggtgattttcatagctataatccttacaatctttttactccctaagtcgttactttattgtgctatttttataatgtgtctggcaaattgtttccttcaattatgagagtgatgtcacaaaattattttattttttaaaataaatgatggaaaattatgctaactcgtggaaagtattagaaaaaatgaataagtatatagaatatcagtgggttgatgataatcctagtttggctcagatgtgtctgcaggttgcagaacaatcggtgattgcgttagatactgagtttgttcgtactcgaacttattatccgaagttggggttaattcagctttttgatggtaagcaggtgtatttgattgatccgttaagtattacggatttttccccttttactgcgttgttaacaaatgaaaatgtgcttaaggtacttcacgcttgtagtgaagatttggaagtttttcaacactatttcaaacagttaccgcaaccaatgttagatacgcaggtgatggcagggtttgtggggataggtatttcaattggctttgccaaacttgcgttgcattatcttgaggttgaattggataaaggggcttctcgcacagattggttgagccgtcctttgagtgagatacaacttcaatatgcctgtgcagatgtgtggtatttgttgacgatttatcacaaattggcggaagatttggcaaaaacactgtggcaaactgccgtcgtagaagagtgtgcaactttgttagctaaacggcagatcgtagaagatccgaataaagcctataaggaaatcagtaatgcgtggcaacttaaccaacaagagctggcaattttgcagatattagctaagtggcggatagaagaagcagaaaaacgtgatttggcattaaattttattattaaagagcagagtttgttacaaattgctaaattacaaccgaaacatacttcaatcttgttggaatttatgcacccaaatgaagtgcgtattcacggtaagaaaattttgtggttagtcgagctgggtaagcaaattttgccagagaactatccgcctgttattcgtcgtttggttgatgaggctggctacaaaactactttcaaacgcttgcaaaagcgtcttacagaagtttgtcctgaaaatttggcgattgagttgttggcgagtaagcgtcaattaaatcagttgtttaaatggtatagaaatgggcaggataggcaaaagttacctgagttattgtgtgggtggagagagcaattcggtaacaaattattgccagaaattgatctaagtaaataaaaacatagagaaatgttttgtgatgtaaagttgctatatttttactaaatgaaggagtaccatgagtcgtagtatcttaggtaagtgtacatccaaaatcatttaaaacaagcggatactttgatttgcaagttggcgatgtaattttagttcctgctgacgataagtaatcttagataaggatattttcctttaaaatcaaattgctacaagtgttaaaatgaaaatatccttataaatcaattggttatatcctattctgttcgcataacgtatattatgttaaataacaaatttaagcggataaatttaagacttttctttcttttttctcttcccttttttactgagatcaatttattttcaagtgtaaaaggcgtatcataggcacgcagtcacgtttacccaaaacgtgttaattttttcttatcacataggtgtttcgacaatgtcaaaaaatattcttattcttaactgtggtagctcatctttaaaattcgctatccttgatcctgtttctggtgatgaaaaattatcaggtttagctgaaaactttaatttagttgacgctcgtattaaatggaaattaaatggtgagaaaggtgcagcagatttaggtgcaggtgcggctcacagtgaagcacttaactatatcgtgaaaaacattttaagtgcagaattaaaagacagcattggtgctatcggtcaccgtatcgttcacggtggtgaaaaatatacttcatctatcgttattacagatgaagtggttgcaggtatcaaagaagctgcagcatttgcaccacttcacaaccctgctcacttaatcggtattgaagaagcattcaaagcattccctgaattaaaagagaaaaacgttgcggtatttgatacagcattccaccaaacaatgcctgaacacgcttatctctatgctcttccatactctttatataaagaacacggcgtacgtcgctatggtttccacggtacaagccactattatgtgagccgtgaagtcgctaaagttgtgggtgttgaaccgtcaaaagtgaacgtgattacttgtcacttaggtaacggtgcttcagttgctgcaatccgtaatggtgaatgtattgatacttcaatgggtttcactccattagaaggtttagtaatgggtactcgttcaggtgacttagaccctgcaatcattttctttatgcacaatacgttaggtatgtctgtaaaagaaattgaagaaacattagtgaaaaaatctggcttattaggtttaacggaagtgacaagcgactgccgttatgcagaagataactacgcaactcacgcagatgcaaaacgtgcaatggacggtttctgctaccgtttagcgaaatacatcggtgcttatatggctgttttaggtgacgatcacttagatgcaatcgtatttactggtggtatcggtgaaaacgcaggcctagtgcgtgaattaaccttaaattacttaaaactgttcggtattaaagttgatagcgagaaaaatacggcagcacgttttggtaaatcaggcgaaattactgctgctgattctgcattccgtgcattcgttatcccaacaaacgaagaacttgttattgcacaagatacagcgtgcttagcgttataatatctaaaacctgccagatggcaggttttttactttttacatcacaaaagcggtgagattttgcaaaatatttgactactctacccgcttgtaacaaggaaaaaaacaatgtccagaacaattattttaattccaatcagtaccggcgttggtttaaccagtgtaagtcttggtttagtccattctcttgaacaaaaaggggcaaaagttggtttcttaaaacctatcgcacaacctattagtggtgaagatacccttgaccgttcaaccactattatccgcctttcacaaagtaccgaaacaggcacaccatttatgctaagtgaagcggaaacattgattgcaaaaaaccaaaccgatgtattacttgaaaaagtggttgagcgtcatcaaaaactcaccaaaaacagtgatattgttattgtggaaggcttaattccaacgcgtaaaaactcttacgcaaatagcattaactatgaaattgcacaagcattagacgctgaaatcgtgttagttgcagcaccggcagcagacaaaccggcacagcttaaagagcgtattgatgctgcagtttctttatttggtggtcgccacaaccctaacctactcggtgtggttatcaacaaatttaatgcccctgttgatgagtcaggtcgtacacgcccagatttaaccgaaatcttcgactcgttccaacacagcagcaataacattcttgaaatggaaaatctgttcaaagctggtccaatcaaattactagcttgtattgcgtggaaatcagatttaattgcaacccgtgcaattgatgttgtaaaacacttaggtgcggcaattattaatgaaggcgaagtacataaacgccgtattcgtagcgtaacattctgtgcaagaagcctaccacatatggttgatcactttaaagcgggcagtttattagtcgcttctgcagatcgtcctgatgtcatcgttgcagcttctttagcagcaatgaacggcgtggaaatcggtgcattactcttaacgggtggctacaaaattgatactcaaattaccaaactttgccaacaagcctttgagactggcttaccaattttccgtattgaaggcaacacttggcaaactgcattaagcctacaaagcttcagccttgaagtaccagtagatgataaagaacgtattgatgcgattaaacaatatgtctcagaacaattcgatgcaggctttattgatggtatttcaaaaggtgcagttcgcgctcgtcgcctctcccctgctgcattccgttatcaattaaccgaacttgcgcgtgaagcgaaaaaacgcattgtgttaccagaaggtgatgagcctcgtaccgttaaagcggctgcactctgtgcggaacgtggcattgcagaatgtgtacttttagcgccacctgcggatgttcaacgtgttgctgaagctcaaggggttactttaggcaaaggcattaccattattgacccagctgaagtgcgtgaaaactatgtagctcgtttagtcgaattgcgtaaaaacaaaggtatgactgaggttgttgctcgtgaacagctgttagatactgttgtactcggtacaatgatgttagaagcaaacgaagtagatggcttagtttcaggtgcagttcacacgactgcaaatacaatccgtccaccaatgcaaattatcaaaacagcaccaggtaactctattatttcatctgtgttctttatgttattaccagatcaagtacttgtttacggtgactgtgcggtaaacccagatccaacacctgaacaattagccgaaatagctatccaatcggctgaatcggcaaaatcattcggtatcgatcctcgtgttgcaatgatttcttactcaacaggaacttctggtgctggtgcagacgtagaaaaagtagctgaagcaactcgtattgcgaaagaaaaacgcccagaccttattattgacggtccattacaatacgatgcggcaattatggaagatgtggctcgctctaaagcgcctaactcccctgttgcaggtaaagcgaccgtattcgtcttcccagacttgaacacaggtaacacaacttataaagcggttcaacgctctgcggatctcgtgtctatcggtccaatgctacaaggtatgcgtaaacctgtgaatgacttatctcgtggtgctttggttgatgatattgtttataccattgcattaacggcaattcaggcgactcagtaaaaaataaactgctagttcaaggactgaatccagttactactggactcagtccgtttaaatacgtcagttatacagcccaatatattattctttaggatatacagcctctgttagaataattcttttgcctcttgaagcaatgattctggtattgaaagtcccagttgtcttgctgttttttgattaatggataattccattttacttacagactgggttgcgatattacctgctttttcacctctgaggatttttgctgcaactttacctgtttctgcaccaatatcatattgattcactgcgtaagcagctagagctcctctttttacagtgtctttatccgcagcaataacaggaatttttgcttcaagtgctgctttgtgtaatgcttcataggcagatactacagcattatcttctgtaatataaatagcttgcacctttccacttaaactacgagcagctgtgccaatatctgcactacgctgcacagctacaggcataatctcaatattagaacctcttattgcattccttaattcttctaacacaacagctgaatttacctctcctgcactgtaaacatatccgagagctttaatatttggtactagtttttggattagtgccaattgtggttcaattggtttatgatctgaaatgcccgttacatttgttttacttggttcccaagatttaatcagcttggcagctacaggatctgttacacctgaaaatacaataggaattgaacgtgttgctgcaacaacaggttgagcacttggtgtcgtaataggaataataatatctgttttatcacctacaaatttacgtgcaatttgagctgcagttgatgtactaccttgagcagattggaaattaatactaatattttttccatcaacaaagccttctctagcgagttcttcaataacaccctgtcgaatagtatctaatgcaggatgctctacaattgcagtaattgcaacattatggattttatcttgtgcagatgcattaaatgcgaaagcagcaagtgcagaaaaaagaattgtttttctcaatttcatatgaatttccttaatttaacttgatgtattaatgtactattaaaatagtacaaagaaggatataaaaattaatctactattgcaagaaaattctaatcgaaataaggaaataatataataaacgtttgttttttaaactagacagaagggggaatgcactatttccccctcagataactcatttaaccaactttaaatgagatgattttttcttagtaacttttttgagtgactgcgctctatttactctatctaaatatgtgtcttcttgatagaaagcttcttcttgaaacattacaccgtcaccattttcctgtgcataaatagcctcgacagcaccgaatggaatataaactccacgagtaattccctgaaatcttgcattgaaactaattgcttcatcagtaacaacatattgtcctatagagcggggagaaatatttaagataattttaccatcacgcacaaattcttggggaacatctgtatctacgtactccgaatttattaataaatatggggtattttcattatctaaaatccaattataataggcttggtataaataaggtcttaaaggtttcatatcagtctttatcatccattaaatttttgggtgtactacctccaatagattgcacaaagctatctcgtttaaaaactctattcatatatgctttaaccgcttttgagcctgccccattaaattctacacctagagtattcattctccacaataaaggggctacatagcaatcaactagactaaaatcttcactcaaaaaataatcagaatctgaaaatactggacctaatgctaatacttcttcgcgtagctgatttaatgctctttgagcttcagctgtagttggatcacgttcaataaaatcaattaaagagaaccaatcattttgaatacgatgtatatttaaacgacattgagctctcagtataggataaacaggcattaatggcgggtgaggaaatcgttcatcaagatattccataatgattcgtgcatttgataatatgagatcacgatcaaccaacactggcacagtacctctaggattgacttcaattaaatcttccgaaattgtgcctggtaaaatattttcaatttcataagcaacgcctttttcagctaaaacgatacgcacttgatgactataaatatctgttttagtagaaaaaagcgtcggaacagaacgtttatttgcactcatcatttatttctcccaatatttaaattttctcaatattcgatcttccgattttagcatagattatctgttaaataacagtgctatttttcttatccaatatcctttacttaggattgatttagagcaacttcttgaaaatttttatataaaccttttgacgatagagtataaaacgtctagcataacaggaatcttttatcaaaatagaggaactatagatggaaaatagcaaaaaacaatcatttcaagatatgctagattatgtgcatctttatcgtttaaaaaataaattattacgtgaaacagcagataatgatcgcaaaatccgtgataatcaaaagcgtattttattacttgataatctaaatcagtacattactgacaatatgtctatccaagacatacgtgtaatcataggtaacatgagagatgactatgaaaaccgagttgatgattatgctatccgtaatgctgaactttctaaagagcgtcgagaaattagacgtaaaatggctgaacattctagtaaaaagtaaatgaacagaacggtaagtcgccaaacttaccgtttttcatatcctactgttcaatccacatcacaaaatctgcaacagtatgaaatgaaccaaacacaagaataatgtcttgttcgttcgctgtttcaaaaagaacttggcttgcttcaataacattttcataggcaacggctttggcgtttggtaaggcagtaagtaatttactttttacctctgtgccactctgcccacgataaccttgtagcccagcacaatgccattcgtcaatcaactcttccaaaggctcaacaatacccgataaatctttatcaaccaatgcactaaacactgcatatattttgcggtttggttgaatccattctgcaagacgatccgataaataacgtgctgcgtgggggttatgtccaacgtcaataatcacctgtgcaagcggtctattttgtgaaaaagttgcaaaatcttgttcgcctaataattgaaaacgcgctgtcatcttcgcctcttcgaccgcttgaacaagaatttcatcactgagttcaaaaggtaactgggttaaaaccgccaaagctgtggcacagtttggctgtggaattttaggcagtggaacagttaaagatttggttttcgattgccactgcaagcggtcagattcgacggaaaatttccaatctatatctcgtctaaaaacgtgacattgcaactcttttgcatggtctaagatactttgggggcaatcagactcgccgataactacaggaatatttgggcggaaaatccccgctttttcacgacctatcgcttcacggttatcgcctaaaaactcaacgtggtcaatatcaatcgaagtgattaccgcaaaatcaggatcgacaatgtttgtggcatctaaacgcccacctaatcctacttccaaaatcgcgacatcaacctttgccttacggaacagatctaacgctgctaaagtaccgaactcaaaataggttaaagaggctgatttgtgctgttcaatatagtcaaaagttgtaattaaatcagcatttccgaccgcttgtccttgaatacgcacacgttcgttatagtggattaagtgtggtgatgaatagaccccgacctttaaacctgcttttaataacaccatttctagcaatttgcaggttgaacctttgccgtttgtacctgcaacggtaatcacataaggggctggcttgagtaaatccaattcttccgcgacttttcggatacgttccaagcccatatcaatcggtttgaaatggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaagccttctggcaatttctcacgcacagtttgttcaatcactcgtggaccagcaaaaccgatcaaggctttaggctctgcgatattaatatcgcctaacattgccaaacttgccgacacaccacctaaggttgggtctgttaaaacagagataaacggcacgcctttttctttcatttttgccaataccgcactggttttcgccatttgcattaatgagaataacgcttcctgcatacgcgcaccgcctgatgctgagaaacagataaacggaatattttcgcttaatgctttttctgctgcacgaacgaattttgctccaacaacagatcccattgagccgcccataaactcaaagttaaaagaagcaacaaccataggcatatcatatagcttgccatacattacgatgaacgagtctttttcgcctgtttgtttttgagccgcagttaaacggtctttatattttttgagatctttaaacttcaacacatcttgtggttcaagttctgcctctaattcttccgcagtatcttggtctaaaagggataataaacgtgtacgcgcatcaatacgcatatgatgatcgcattttgggcaaacttgcatattgcgtttaagttcctcgctataaagaacctgctcacaacttgtacattttgtccaaacgccctctggaatttttgatttaccacttgatgatgaggacgtttttcctaaaattttttcaatccagctcattgttacaccttaattgtgttgagaaaattgagcgtattaaaacataaaattatataaaaatacatatgtaaaatagccctagatgttttattgtggatcaattaagtcaactaatttcataatgacttcgtcaattaaataatcctctgctttagtcgcatacttagcttggcgttcttttaaatctaaggctcttacttggtgacataaaataacacctgttaccttacctgattctgtactactaccatcaagtacaacagttatattctgcgaacgagccgcattgccacccgcagatattgggcaacaaattgctgtgcctaatgcttgattcaataattcgtccgataccacaataaaataatgaggagagcgaagctcgtgacctttcgttggattcggatcaacataccaaatctctccttttttcggaacacgcattaccatacttctttcccagtgggttgagattgggaaaattctgccactgttgtgttcaactccgcaacttcttgactatcaatacctgctaacaattctgcaactgtcttacgacctcgtgcttgacgcttaataggggtgagtatgacactttctccccttgtctccaaattgactttatgaccaatttgccaccccatttgttgcaatattgccattggtacagtcaagacagcggccccaccttgttgtcttaatgtcgcttgcataactacctctctcagtgttactttgtgcaacattatagagcaatttatctcacattcaagtgatgattgtgtgctaatttatttctgcttgttcaaactgtaaaaagaatatcgtagcttggaatatttacatttttattctattcgcaaataatttactaaaaatcaccgcttgccccttgccaaaaggtataaatcctcgtataaatccacctatttgcaaacacatattaagaggaaaactatgtcaatgtttaaccacattcaagcagcaccagccgatccaattttaggtttaggcgaagcatttaaagcagaaactcgccctgagaaaatcaacttagggattggggtttataaagatgcgaaggggcaaacgcctatcgttaaagcggtaaaagaagcagaaacgcgtttactggctaaagagaataccaaaaattacctaacgattgacggtattgctgatttcaatgcacaaacccaagagttattattcggggcaggtgcggaagtaattacctctggacgtgctaaaacggcacaaagccttggcggtactggtgcgttacgcattgcggcagaatttgttaaacgccaaaccaatacacaaaacgtatggatttcaaccccaacttggccaaaccacaatgcaattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtctgcggaaaaaggttggttgccattatttgactttgcttatcaaggctttgcaaacggcttagaggaagatgcctttggcttacgcaccttcgtgaaaaatcaccgtgaagtgttagtggcaagctcttactctaaaaactttggtttatacaacgagcgtgttggggcatttaccttagttgcagatagtgcagaagtggcaaataatgcgttcagccaagtaaaatcgattattcgtgtactctactctaacccatcttcacacggggcaagtgccgttgcgacagtgttagctgatccacaattaaaagctaactggattgaagaactggctgaaatgcgtaaccgtatcaaagagatgcgtgcaaaatttgtggcattgttgaaagagaaaggtgcaactcaaaacttcgattttatcattgcacaaaacggtatgttctcgtttagtggcttaacccctgaacaagtggatcgtttacgcgatgaatttgcgatttatgcagtgcgttcaggccgtatcaatgtggcaggtattaccgaagataatatcgacgcattgtgtgaagcgattgtaaaagtactttaattttaaatgcatagtagacaagcctttatactttaattatttttgtctgctatgctcgtagtttttcaggagagaataatataatttactctctcttttcctttaatgtaataaccccaatgccatactcgccccaacaatcacaatccctgcaaacacaagttgcattgatgaaatggtttcacctaggagcagataagcaataaatgcggttgagatcggcattaataattcaagtacttgataggtgatgataccctgtttctggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgatatgaaacaatttgatgcaatcatcattggggctggagcagcaggtttattttgtgcggcacagctcgggcaagggggaaaatcggtactggtgctggataacggcaaaaaaatcgggcggaagattttaatgtcgggcggtggcttttgtaattttaccaatctagatgtcacccccaaccattatatttgccaaaatcgccatttcgtcaagtcagcactggctcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactgttctgtgatgaaagttcgcaacagattgtcgatctgctacaagccgaatgtgagaaaggtagggtggatattcagcttcgacaagcggtcaattctatcgaaaaatctgcaaattttttccacattcagaccgtttgcgaaagctatcagacggaaaatctgattattgccacaggtggtttatcaatggctggcttaggggcaaactcattcggttataaaatcgccgagcagtttggtattcccgttatccccgttcgtgcaagccttgtgccgtttacttggaaagaaaacgataagatttttgccaccttatctggtatcgctttacccgttagcgtaagcaatcgtaataaaacctttagcaatcagatgttgtttactcatcgtggattatctggacctgctattctacaaatttcaaactactgggatttgggtgaaacggtggaaattgatttactgccgtcctcctctatccttgatattttgaacaaattgcgtcaatcttcgccgaaattgcaattaaaaaccgtattatctcgctatttaccgaaaaaattagtcgaactgtggattgagcaacagatgatcaaagatcagattatcgctcaactgaataagtcggatcttgcttttttagatcactttattcatcactggcagtttttaccaaacggtactgaaggctatcgcaccgctgaagtcacaatgggtggcgttgataccgattatatttcgtccaaaacaatggaagcgaaaaacgttcagggtttatattttatcggtgaagtgcttgatgtgacaggctggctcggcggctataatttccaatgggcgtggtcgtcggcatttgcttgtgcggaagggctaaaaagtaaatgaaacatttgtagaagatcaattctgatcttctacaaaaactatcaatatttataggagggttacttatgaaagatatttcgcttttaattctttcacaaccgctttttgttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatttgacgagcacggataccgttgacgttgaaggtactaccgattgcaccatctacacctaatacggttgcaggtaacatcatttcatcaaaacctgcatagattaagtggttcgggaacgctttgcgtaaacgttctaacaggtagaaatcgcctgcggtgaattttacaccaatgattttttcattttggaacagttctgcaaattgtgaaacgccgatgtttacccctgttaagaatgggatagagtaaacaatcattttgttacctgtttcacgaataatggtttcgtagaggtttttgatttctgggaagctgaatttgtagtagaatggtgttactgcagataagctgtcatagcctaattctgttgcatatttaccaagttctaccgcttcttttaagtttacgctaccgacttgagcgattaatgcaatgtcatctttcgcttcatcttttgcgatacgaaagatctcttttttctcttccgttgatagcataaagttttcacctgttgaaccacctacatacaagccatcgactttcattttgtcgatattgtaacggataatttggcgtaaacctttttcgttgattgtgccatctgcattaaaagaaactaataatgcactgaaaataccttttaaatttttcatatgggtttccttattaaagtaaagtatagataaatgatagcggtctgtttcacaaaaaaactatcaaactgaccgcttgtagtttatttaagccgttgatctaaaataacactcaacgttttctgtttttgttgaatcgctttttctggttcagctttcactaacaaggcataaattaaatccagtacaaaaagttgggtcatttttgtaccaattgaatccccctgcatatgcccctgacggttaccattgattaacacataatccgcttctttcgtaataggcgaacgtaaattatgggtaatagcaaccgtttttgccccattgtctcttgatatttttagggctttcgtcgtttcttctgaataaccagaatggctaatgccaataacaatgtctccttttttcagcaatgctgcttgcatatacataaaatggttatttgtcacagcagccgcgtgtagcccaattcgcattaatttgtgctgagcgtcttctgctgttagaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcaatttctttaggtgtatcagtttccgcaacgtacgtatctaacaacgtactactctctttttgctgagtagccaattcaatggcaagatcgagtttaaagtctgtataacctttaaatcccaatgttcgacaaaaacgaataaaggttgcttcgccgacatctaattgatttgccactttagataaagaacattggttcaatagatcgggctgagataaaatcgccgtcgcaatttttttctctgttttagttaaactattttgtaacgcaccaatcgtatctagaattttacctcgggctgacattctagcctcctatcatctccactggcactttcaccactaattttttcaatggcttactttcggtcacaaaattgcccggtgtgtgtggctcataaggtaagaaaatagcaaacatattaggttttaaaattacaacatttttatgttctaaggttggtgtaagctgataatcgtcctcatcacgatattcatcataaagtgctaagttaggataggctaaactgtattcaatcgcttcttgacctgatatcaacaattgaatatcaataaatttacgatggagctccgctttttttccttctggggaagaggtttcaaattccatcacattcattcttactccctcttccaaatcttgccaacctaatggcagattaactaaatcaagggttttaagtttagtacatagtcttgcaaagacaggcggaagtgaaagaatataatcatcacgagaaagatcacctaataacatatagcctcctaatgtttcaccgcacattaaatgaaaagattactccataaaaaatagcataaaagaaaatatactccatagagtaaaactttctcgaccaaatgacaaggtataaacctaaaaaatgagaggtaaatcacaatttacttgatttaaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaaacgtcgcattatacttttggtgaaaaaataaatgcttcatttctgatgggtgttggtcccgtagaagatttgtctaatgagtaagttttatcgaattcaaaaggaaaatttttaatcatgttgcttttttctataaaagaaccatgatagacacgattatttttgccttccaatagattagatacttgatttaccaaattcagtaccagttcatcactaatatctagtacctcctcttttagtccttgaccaaaagctgatgagcaattttctttgaaatccaatttggcaaagcatactaagaggtgctacttaatctacaaccaaacgaagctgcctaaaatagagtgtattcatacaatatcagtaaacacaggggagtccagatggaaaaggtgattcagtcacaaactggaagaaaaatctactcaaaatgtagcagttgcgatgcttctatagagttcaacgaaaaagaaaaaggcgtttttttgaaaaagtgtgctgtgtgctttctactaattcaagattgaaccttatgtaatccgtttgggtatagatgatatagcaaaagaccagaatcttgtaaattccggtcttttgagattatattacaatctatgatttggattattggtgctctgggcgagactcgaactcgcacatcctctggacactaccccctcaagatagcgtgtctaccaattccaccaccagagcgtaaattctatttttattgaggaatatcgctattttctattttagctggagcaacttcttgtttttgctctacgttacttaaatcttcaaattggctttttggtgctgaggtttgtgaatttaagttgccgataacgaggcttacgctaaaaaagataatcgctaaaatcgctgttgttcttgataaaaagtttgcagaacctgctgaaccaaataccgttccagctgcaccagcaccaaatgaagcaccagcgtctgcacctttaccctgttgcattaaaataaagccaacgaggaagattgcaacaacgagataaacaatagtcagtacattaattaacattgtgttctctttaatctgttcaaaataaaattccgcaggttgcggaattaactttcgatggcgtgaataatagctatctttacttttccttgcaagtggattttatcaatttctgtgtattcggtttatttttcaacattttgcgtagatttacgggcataacgtgatttagaacccattgtaagcggtgttattttcgccaaattttgcaaaatctgctgatttggagaacgtaataaactcggcaatcgttggtttaaatctgccataaattgttgataactggcttgttttttgctgatgtctgttagttgcatttcccagtgagctgtcatatcaggctgtgttgcaacatctggcaaggcactaattaaggttcgtcctgcttctgtactatgaatgtttctgccttttttgattaaaaagccacgtttgaataataattcaataataccagctcgggtggcttctgtacccaagccgtcggtttccctcaacacttttttgagctgtttatcctgtacaaagcgagcaatgcccgtcattgcggataacaaggtcgcatcagtaaaatggcgtgggggctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacgatttcatcattatcttctttgcctaacaaggacttccaacctgcaacaacaaggtttctggcttgcgcaacaaaagtcccccctgcgatatttaacacaatttttcctttacgatattctgcgtcagggcaaaactgcattaaatattgtcgagcaataagctgataaatccgctgttcattttgggttaagtgaacttgcccttgacgtgccgttgggataatagcgtggtgggcttctaccttactgtcattccagcaacggtttttcttattcggatcaacagcatcgggcttttgagcatactcaggcagatgataagcaattgccgccatcacttttaggcggtcggcaaaatgttcattcggcaaataacggttgtcggaacgagggtaagtaatcaatttatgggtttcatacagccgttggcaaacatcaagcacatcttgggcagataagccaaaacggcgagccgcatcaatttgcaaggctgagagtgaataagggagtggtgctgcttcactttccattttatcttgatattcggtaacgcaagcggcttgatcggcgatacgttttaccacattctcagcaagtgggcgagaaatcactcgtccatcttcatcttgataatcttcgcaggctttacttggttgccattgtgcttgaaaacgttcttgggtttcaggaacaaccacatttgccaacacttcaaaataatcttttgggataaaattttcaatctcaagatcacgtcggacaatcaagcccaacactggcgtttgtacacgtccaacagacagcacgcctttataacctgcccaacgcccttgtagcgtataggctctggtcatattgatcccatatagccagtctgcccttgcacgagctaaagccgatgtagcaagcggtacgaaatctcgattaaattgcaatttttcaatcgcttttttgacagcattcggattgagatcgctaatcaaacagcgctgaatttgggatttacgctcaggggataaatttaagtagccaaaaacttcgtccaccaacagttgtccttcacgatctgggtcgcctgcattgactaaaatatccgcttgtttaattaaacgctctaccaccttaaactgcttgagtgtctcttttttggggatcagcttccactgttcagggataatcggcaaatgttccattcgccacattttgaaacgttcatcataagcatcaggttcagcttgttctaacaagtgaccgatacaccaagtaaccacattgtcttcgccacactgaataaagccgtccccacgggtatggggtttcggcaatacatcagcaatcgcacgccctaaacttggcttttctgcaatgaataaacgcataaattgcttatagaccttgtgatgataagagcatttgacaaagttgtggcggttgtggaatagtttttgcttttggtgttgttgatggcggtgcaggctcaaaccaagaataaagttcttcaccacagccatcgccagcaggcacaggggcttgattttcacagttcgccgcatctgcagggcaagttaaacgaacgtgaaaatgcgagtcgtgggcgtaccacggacgaattttgcgtagccagttgcgatccgttcctgcggtattacagagtttcactttaatcgctggattgacaaaaatacgatcaactcttggatctgacgcagcgagtttgagtagttttgtatggtttgccgtccatagacgttcatctactacgttagtcttacgatcaaccataatggtcgctaaaccagctggatttcgagctgtttcatcgtccattggaccaaaacgaagccaaatatcggcatctaaccctgtttgatggctggcgtgtccagatgaaaaacgccccccagcaggcatacccatatccccaattaaaatcggtggaatgcctgacgctttagcatttttggctaaggtttttaggtagcttaataattgtgggtgtccgtaataacggtttttgacagaacgaataacttggtagccttcgccttttaatgcgagcggttgagcaccgataatacagccgttgctatatcccccaatggattgagccttacccaccacaggcgtgcggattttttcccattgggttgcaaaagcggtggcggataagagtgctaaacctgaaacaaaggcggttttaatcaatttcattttcttctccagacctatactaatttaatatgtatggtaatctcttccctatcgtgatacaaatgttttgtctgaatagcaaatttcagcccttgtttctctaataacgaagcaatcgtatctcctgcaacaactcgcctaccacaatcatttgacgaacaaaaatcaactgattaaaggctaattctctggctaatctatccgcttcccctgcctgatagcactcaaaaatcacataaccactgttctctttgagattagcaaacccataaattcccaattgagccgctttatcattgatttcacctgccacttccttttcaaaacctgcacggcggtgtaaagctaatttattcattacttctgacttctcacactaatataaaccaacgccgcccagcccactaaaaatagcgtaccgccaataggcgttgtccaaacaaaaattcggcttgcccctagggctaacgcatataaactgccactaaacagcaaaatccctaacacccaactaccgccaataatgttaaaggctttggctctacaagcgggaggattttgcgaaaaatttgcaatttgaaacagccccaacgccatcaatgctaacgtatgaaacatctgatattgcaggcctgtttcaatccacgccaacgctttctgatctaaaaccttctccaaaccgtgagccgcaaaagccccaaaagcgatacagaaaaagccacttagggctgaaaaaagaagaaatttgtttttcatcgtatctccttaaaattttcgtgcaatatatcacattcctttttaagcaaaaacaaaaggctaagcactttcgtacttagcctttgttggtaatacgttgtttaatgatattaccacccaaatgggcatctattagaccattctttgcacgttgaatggcttcaagcagttgagtatctgtaatatgttgctttgttgcaaataaccgctcgaatgacagcatatcaaatgttaatgggaaaaaatcccacataaaacaatactatactgtctgaataaggatatccgcactaattcccatcttataatgaatattgcggatcatatttagtgtcaatggtcttttcttattaaaaacttctgatacacgattaggttttccgataataccatctaaatctttgatattaagcccctcctgctccattctaaattttatcgcttcaatcggggtaggtggatcaatcggataatgttttgcttcataattttcaatcaatgtcaccattacatcaaaatagtctaattcatcttgggttagctcatcttctttatcaaaaaaaggttcaataagagaaagggcttcttggtaatcttgttcagttctaagtggtttaatattcatttatttctcctatgcttgttcgtggctatttgcgtctatcttgtcatattcttcgtgagtaccaataaatttaatataaaccgctcctaatttataggcaattgcaacaactaatctatggtggtttcctttaatattaaaaacaactcgtctatcttttagaatactcgcatttctatattgttgtttaatttcatttgcggtttgccaattcgctttttttacttctgaaatccaagcctttaatggttgctctgtttcagggtgcttagtgtaataatccaccaattttgatgttgaaataattcgcataacgatccctctgaataacttacactttatcccagtttgggattttttgcaattcttttaaaccccctgatgtatcttcccactctaaaaccaccgcttgtgtatcgaccaagcacgaccagtgtgtgcgtttatccattactctttttccattaaataaaaataggattagcctaacagaaaccatcataaaaaccttgatatgtatcaaaaggggtttgccccgataaaataacgttgcttaattaaacaatcacataacaacctcttgcttaattgtcattcagttactacaattcccaacattatccgaccccgagcctgttttcctaagtctagcgatatggaaactgtgcctgtaattgattgattacacagggaaagttgagaaatcggctctcctctcatatttagaaaggtgtcacattgcaaatcccaattagaaatgtagggaacgagttcgagcaaactttgattgaccgtttccaacgtcaatacacttatttacggttgtcgattaccgatgtctgtaactttcgttgcaactattgtttgcccgaggggtatcgtccgccgttgcataaacaaacctttctgtctgtcgatgaaattcaacgtgttgctcaagcctttgccaatttaggcacggaaaaaatccgtattactggtggtgagccgactttacgcaaggattttctagaaatcgctcatcgcctttcacaaacggcaggtattcgccaaattgcattaactaccaacggttatcgaatggaacgtgatgttgagttatggcaacaagctggaattacccatttaaacgtgagtgttgatagccttgagccacgtcaatttcatttgattacaggggaaaataaactcgcaacggtgttaaacggtattgagcgtgcctttgaaattggctataaaaaagtcaaagtgaatgccgtgttgatgaagcaatataccgctaaaggtttggacgatttcctgcgttggattaaagatcgccctattcaaatgcggtttattgagttaatggaaaccagcgaaatggatcactttttccagcaacagcacctttcagggcaatctattttagaacgattaacccaagaaggttggcaattacaacccaaagcgatgtctgacggccctgctaaagttctcgcccaccctgattatcaaggggaaatcggtttgattatgccttatgaaaagaatttttgtgccagctgtaaccgtttgagagtgtcggcattaggcaaattgcacctttgtttgttcggcgaagaaggtattgatattcgggatttattgcaatcggacgagcaacaatttcaactcgaagccagattaaaatccgctctgcaaggcaagcgcgaacaccattatttgcatattggcgatagtggcgtgagaaataatttggcatcgattggagggtaatctgtagggacacactgcgtgtgtccaaaaatctattatgaaacacagttgctacatcattaatattttacaaagagaaaataatgaacacctttacccatataaaccaaaacggcgaagccaatatggttgatgtttctgccaagcaagataccgtgcgagaagctcgtgcggaagcctttgtgacaatgaaccctgaaacgttacagatgatcatttcaggcaaccaccacaaaggcgatgtttttgccactgctcgcattgccggcattcaagcggcaaaaagaacgtgggaactcattcccctttgccacccacttctgctttctaaagtggaagtgcaacttgaagcattgcctgaaaaaaatcaagtgcggattgaatccctgtgcaaactgtcgggcaaaaccggcgtagaaatggaagccttaaccgcagccagtgccgctgctttgacgatttatgatatgtgcaaggcggtacaaaaagatatggtaatcgaacaagttcgcttgctcagtaaaagcggtgggaaatcaggcgatttcgttgccaaaccataatattttgtaggggcaaatcatatttgccccaatagaccccaaattattaataagattagttaaaaatgattaaagtactctttttcgcccaaacccgtgaattagtgggcgtagatagcttagaggttgaagcaacctttgccatagctgaacagcttcgccaacatttagccgaacgtagcgacaaatgggcattagcattacaagcagggaaattgttagtcgccattaatcaaactatttcccctttgtctgctgaaattaaagacggcgatgaagtggctttctttccaccagtaactgggggctaaatggaacaaacacttattcaagttcaacaagatcccttcgatcaaaatgcgatctataaatggttgagtgaacaacattccgttggtgcaactaccctttttgtcggcaaagtgcgtgaaatgaatttgggcgatagcgtgtcaggtttatacttggaacactaccctgcaatgaccgaaaaagccttgcgagcaattgttgatgaagcaagaagccgttgggaactgcaacgcgttgcggttattcaccgtatcggacagctttatacgggcgatgaaatcgtcttagtcggcgtcagttccgctcatcgtggcaacgcctaccacgccaatgaatttattatggactatctgaaaaccaaagccccattctggaaacgtgaaaccaccgaccactgcgaccgttggattgaagggcgtgagagcgatcaggaagcggcggataagtggtaacaagcggtcagatttaaggaattttttgcaaatgaatttatatatcgatctccaaattgcctctgaaaatacagtaggcttaccgacggcagctcaatttcaacactgggtggataaagcgttagccatggaagcgaaaacggcggattatcctgaaacggaaatcactattcggattgttgatgaagcagaaagtcacgagttaaatttaacctaccgcggcaaagacaaaccgactaacgtactctcttttccgtttgaagtgccagaagggattgagttaccgctgttaggggatttgattatctgtcgtcaggtcgtcgaaaaagaagcagttgaacaagaaaaaccgctcgaagctcactgggcgcatctggcaattcacggtacattacatctgcttggctacgaccatttaaccgatgaagaagccgaagaaatggaaagtctggaaacggaaattatgcagtcgctagggtttgatgatccctatattgcggaaaaaacgattgaagaataatgcgtcatctaacggttatcgatcatctcccatcttcttttgagactgccgatgtcggcggtattttcttacctgattcgccgatatctctccccttctccaacgccaaaacattactcggtcaagagtttccctatgctatttacgatatgcgaactgaaggcggtgtttgtcttaatcttgacgcattggcgattgtggcaggcactattcaagaaggtggaacgctctatttggtctgtccagaatgggataatttagagcaacaagtcgattttgatgcgttacgttggaacgctcaacagccgattgctacaccgaatttctttcgttattttaaaacgctggtcaatgaaattctgcccccgtttacgggggaagtaccctgcgaagcagggggaaggggggaaattgtttttacccaagatcagcaaaatatcttcgataacttaccgcttgatcctgccgatgttcatcttattctcgcctctcgtggtcgtggaaaatcgacattatcgggcaagctcgcagaaaagctctctcagcaatatacggtatccattaccgcccgtagccattcagccttaccaaatttttggaaagagattgaaagcgataaagtgcaattctttgcccctgatcgtttaattcagatgatcgaacagcaaaatatctcaccgaagcaatggctatttattgatgaagcagcgagtttgcctttgccgatgttgcaacagttttgtgcctattttgataaagtggtgctaaccaccacaactcaaaattatgaaggtactggacgtggtttttgtttgaagtttttgccgacattaagccgttcaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttatttggataaattaattaacttttatcacctactcgcccaagcacattacaaaacaacgccaacggatttgcgtcgtctgtttgacgcacctgatcaacgctatttttatcttgaagagcaggaaaagttgatcgcgggttgctgggcggtgaatgaagggggattagatgaggaactcactcaggctatttggcgtggcgaacgccgtccgcaagggaatttggttgctcaatatctctgttttcaaggcaatttacctgatgcttgccgtttgaagtctgtgcgaatttcgcggattgcggtacagcctgaatgtcagaagcaaggctatggcaagcggttggtttcgcagattatttcgcaaatgccaccgcttgtcgattttgtttcggttagttttgggcttactcctgaattattgtatttttggcaatcttgcggttttagtttggttcagattaccccagcccctgaagcaagcagtggctatcacagtgcaatgatgatttatccgctttctgaacaaggtaaaacatttgctcaacaagcaaagcaacagtttgaacgagattttccgctgttgccttttgccgatcgttttcagcatattgctatttctacttccttaaattcgcttattttggatcataacgatgaaagaaacctacaaggatttatttatgctcaacgaacccttactgcttgttatgtcagcttaaagcgtttatatatcaatcacaactcgtttgattttttatcagatatctttactaactctgatgaaaataagaaatcaaaacaaaaacaatgggttatagaacttaaaaataaactgaaaacaatttcatcaatcggaaaaacctaacgaaaccgcttgcgattttgtgaatgcgatcacattttttttgctttttttggagtaaaattccaatagttactatctatagtgacaattttatctcattcagaaatccataaaggagctaattatgaaaaaagcggtacttagtacaatcgcattagcagtaggtttaggtgcagtagctacatcagcacaagcagcggatcgcattggtgtgacaatctataaatatgatgacaactttatgtcgttaatgcgtcaagaaattgaaaaagaagtgaaagtagttggtggtgttgatttattaatgaacgactctcaaaacgctcaatcaatccaaaacgaccaagttgatgtattaatttcaaaaggcgttaaagctcttgcgatcaacttagttgacccatcagcagctccaaccattatcggtaaagcaaaaccagaaggtatccctgtggtattctttaacaaagacccaggcgataaggcaattgctagctacgacaaagcattctacgttggtactaacccacaagagtcaggcgtaattcaaggtgaattaattgcgaaacactggaaagcaaacccagcgtatgacttaaacaaagacggtaaaatccaatacgttatgttaaaaggtgaaccaggtcacccagatgctgaagctcgtactaaatattctgttgagcaattaaataaattaggtatccaaacagaagaactcttcgtagatactggtatgtgggacgcagcgcttgcaaaagataaagtagatgcttggttatctagctcaaaagcaagcaacattgaagttgtgattgcaaacaacgatggtatggcgatgggtgcattagaagcagctaaagcacacggtaaaaaattacctatcttcggtgttgatgcgttaccagaagtacttcaattaatccaaaaaggtgaaattgcaggtactgtattaaatgacggtgtaaaccaaggtaaagcagttgtgcatctcgctaaaaacttagccgcagagaaagcaccaactgaaggtactaaatgggaattaaaagagaaagtattacgtattccttatgttggcgtagataaagataacctttctgaattcttaaaataatgatttgtagtttgggggagggaaacctccccttattttgtgaggttggatatgacagaaaacacagaacatccagagagccaagtgcttctccaaatgaccaatgtcagtaaatcctttcctggtgtaaaagcattagataacgcaaacttgactgttcgttctcattcggttcacgctttaatgggtgaaaatggggcgggtaaatcaacgttgctgaaatgtttatttggtatctatgccaaagatgaaggcgatattctatttctagacaaacctgttaattttaaaacctctaaagaagccttagagaatggaatttcaatggttcaccaagaattaaatcttgtccgtcagcgtaacgtaatggacaatctttggcttggtcgctacccattgaaaggtatgtttgtggatcacgcaaaaatgtatcgagacaccaaagcgatttttgatgaacttgatattgatattgatccaaaagaaaaagtggcaaatctctctgtatcacaaatgcagatgatcgaaattgccaaggcgttctcttataacgctaaaattgtgattatggacgaaccaacgtcttcactttcagaaaaagaagtggaacatctgttcaaaattattgaaaaactaaaaaatcgtggctgtggcattatctatatttctcacaaaatggacgaaattttcaaaatttgtgatgaaattacgatcttgcgtgatggtaaatggatcaatactgtcccagtaaaagaaacgacaatggacggcattgtatcaatgatggtaggacgtgaattaactcaacgcttcccaccaaaaaccaatacaccaaaagaagtgattttagaagtacaacacctgactgccaaaaatcaaccgtctatccaagatgtcagctttgaattacgcaaaggggaaatcttagggattgcaggcttagttggggcaaaacgtacggatattgtcgaaaccattttcggcgtgcgtgagcgaaaagaaggctcagtgaaattgcacggaaaagaaatggcaaatcacaccgctttagaagccatcaacaacggctttgcactggtgacggaagaacgccgttcaacagggatctatgcgaacttaagcattgaatttaactcattgatttctaatatgaaatcctacttaggttcgtttggattactcagcagtgctaaaatgaagagcgatacccaatgggtgatcgattccatgaatgtgaaaacaccatctcataaaacgaatatcggatcgttgtcaggcggtaaccaacaaaaagtagttatcggacgttggctattaacgcaacctgaaattcttatgcttgatgaacctactcgtggtatcgacatcggcgcaaaatatgagatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcagctcattatgcaactggctcaaaaagataaaggcattattatgatctcatcagaaatgcctgaattattaggggtgacagaccgaattttagtgatgagcaatggtagagttgcagggatcgtagaaacagctaaaacatctcaagaagagattttacagctttctgcgaaatatttataaaagaaggaagtgaattatgtccacacttactcaaactaaatctttagattttcttaaacaaaatgcgatttattttgtattgcttgtgttattagtgatcattatcgcacaagatccaagtttcttaagtttacgcaactttagtaacatcttaacccaatcttcagtgcgtttaatcattgcacttggggttgctggtttgcttgtatcacaaggtactgacttatccgcaggtcgccaagttggtttagctgcggtagttgctgcaacaatgctacaagcaatggataatatgaaccgagtgttcccaaatctaggcgaaattccaattccagtggttattttaactgtatgtgctatcggtgctgtcatcggtttagtcaatggtttagttatcgcctatctcaacgtaacgccgtttatcgcgacaatgggaacaatgatcatcgtctatggtatcaactcactctactatgatgctgtaggttcatcaccaatcgcaggctttgacgaaagtttctcaacctttgcacaaggcttcttccaaatcggtagctttagattgtcttacatcactatctatgcggcgattgcctcaatccttgtttggattatgtggaacaaaactcgctttggtaaaaatatcttcgctatcggcggtaacccagaagctgcaaaagtatctggtgtaaacgttgctcgtaacttagtggttatctatatgatcgcaggcgttttctacgccttcggtggtatgttagaagctggtcgtatcggtagtgcaactaacaacttaggctttatgtacgagttagatgcgattgctgcttgcgtagtaggtggtgtatctttcgctggaggtgtaggtacagtaatcggcgtggtaacaggagtactaatcttcaccgttatcaactacggcttaacctatattggtgtaaacccatactggcagtacatcatcaaaggtagcattatcatctttgcagttgcaattgactcgctcaaatatgcgaagaaaaaatagtcatagatagggcttaaaaccttttataatacaaggctttaagctcttttttaaaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacacatttcacaacaattcgttgccaaataatatctatatttttatagcaaatattaccagccttttaccatcgcacctttgaacacttcgttcgctttattgaacacttcttcagattgataggctttaataaaatctttgacaatttccttatctttgttatcttcacgagaaactattaaattcacataaggtgaatttttatcttctacaaagatgccatctttggttggcgtcaaaccaacttgacccgcataagttgtattaatgatagaaaatgctacatcatcaagggtgcgaggaagcaatggcgcttcaacttcttgaatctctaaatttttcgggttttccacaatatcgacacgagttgaaagtaagttagtattgtcttttaacttaattaacccttgtttctcaagtagaattagtgctcgacctaaatttgttggatcgtttggtaccgcaattttatcgccttctttaagttcattaattgacttaatttttttagaataggctgcaatcggataaacgaatgtattacctactggtattaatttgtagcctttatctgcgatttgtttgtctaaatacggcttgtgttggaacgcattgacatctaaatcgcctttatttaaggcttcgtttggtgttgcgtaatcggtgaaaatcactaactctaaatcacggttatacttctctttggcaactttagctgccacttccatgacttcatgctcaggtcctgaaattacaccaacttttaatacttcttttttctcattacaccctgttaaaaccaaggtagaaacaaaggttaatcctaataagtgtttgaaattcatattatatcctctcaataataaaaaagagtgactagtacctagtactaaatcactctcttttgttgagttaaattaccagccttttaccacgccatctttgaaatgtttttgagcttcttggaacacttcttcagtttggtatgctttcacgaagttttgtactgcttcacttgcttggttatctttacgagcaacgattaagtttacataaggtgattctttattttcaacgaaaacaccgtgttctgttgcatttaaaccaacttgacctgcataagtgttatttacaaccgctaaatctacatcatctaatgctttcgccgcaacagaagtatcaacttcctgaatctttaagtttttcgggttttcaacgatgtctaatgaagtagagaataagttggtattatcttttaacttaattaagtcttgtttttctaataaaattaatgcacgagcaaggttacttgggtcatttggtacagcaaccactgcaccatcttgtaactcagcgacatttttgatttttttagagtaacctgctaatggatacacgaaagtattacccacgatcactaagttatccaaaccttttgatgaagagtctttatctaaataaggcttatgttggaaagcatttgcatctaaatcacctttgcttaccgctgtatttggtaacgcatagtcattgaacaacacaaattcaacttctaaaccatatttttcttttgcaatttgagctgctttttcagcaacagtatgctcaggaccagacattacacccactttgattttttgtgcttgtgctgctggagcaggtgctgccgctggagcttctgcttttttctcttctttacagccagttaatgctaaagcagaaaccacggctaaacctaataattttttaaagttcataggaaagtcctcttaaaagttatgtttgcaaattaacgatgatcgtaacgttttgcgagattatcgcctattttttggctaatcatcacaatcgctacgataataacagttgcgatccattttacatagaccatattacgatgttcgccgtaactgatagctaagttccccaagccaccaccaccaacagcaccagccattgctgaatagccaattaaagcgaccaacgttagcgtaatgccattgattaaaatcggcaaagattcaggcaaatagaatttagaaaccacttgccaatttgttgctcccattgattttgccgcttccgtcaaaccacttggaatttctaagagtgcatttgacgttaaacgtgcaaaaaacggaatagcagaaacacttaatggcacaatcgccgccgtcgttcctagtgttgtaccaaccagtaaacgcgtaaaaggcaataacaccaccagtagaataataaagggaactgaacgcccaatattgataatcacatcaagtacttgatgtaaacctttatgctctaaaatttctcctttgcctgttaaaaaagcaatgaagccaatcggcatccccacaacgaccgccaaagccgttgccgcaaatcccatatagagcgtttctaatgtggacaacgccaccaattcccacatctttggtgtgagttcattgataaaatcattccacataacctaatacctcaactttgacattattatcaatcaaataaaatcttgcttctgcaatcgcatcgtgattaccttctacttcagcaatcacaaaaccaaacttcacaccacccgcataatcaatctgcgacatcaaaatactaaagtcgatcccaaatttcttcgatgcgtgagaaagcaatggtgcatcaacagaacgccctgtaaattcaaatttaatgatcggcttactagttggcgtttgtgtttgagaaagctgttccatatattcctgcggtaattcaatatggaaagtagattgaataaaacgttgtgccaattctgtttttggattggaaaaaatctcactaaccgaaccgctttctactaaatgccctttctcaatcactgctacacgatcacaaatacgtttaaccacttccatctcgtgcgtaatcaacaagatcgtcaagcctaaacgtttattaatatctttcagcaattgtaagatcgactgcgttgttgccggatctaacgcactggttgcttcatcacacagcaatacctgcggatcatttgccaacgcacgagcaattgccacacgctgtttttgaccacctgaaagattgctcggataagcatcgtgtttatccgccaaaccaactaactctagcaactcactgactttttgctgaatttgctctttcggcgtatggtttaactctaacgataacgccacattctcaaacacagtacgagaagagagcaaattaaaatgttggaagatcatactgatcttacgacgagcaaggtttaactctttctcagaaagcgtcgttaaatctttaccatcaacaatcacttgcccgatagttggacgttctaataaatttacgcaacgaatgagcgtacttttacccgcccccgaagcaccgataacaccataaattgtaccttttggcacttcaaggctaacattatcaagggcagtaattttcttccctttcacctcaaactgcttgctgacatttttcagctgaatcatagttatcaatccacactttatcaaaaattaaaatctaggctattttagacgtctagattgctatgtcaattcaaaaatgaaattttttattcaaaaatggaatattatgatagatagctttcctaaatgccttatggaactactgaaatagattcacatcaaatttctacaacttcgtctattgattatcctcgataagaaaattaaatttttacaagccttttccaacattcctgattataatagtccgaattttttagtccttatttaggagcccgtggatattattattaattttgcgatttaccttcagttttttatcggtttattcgctatcgtaaacccattcggaactttaccgatcttttttagtatgactgctcatcagtatgaagctgatcgcaatcgtactaatttgatcacctccgtttctgttggggttattttgcttgtcagtctattttttggaaaagtgattttagatgctttcagtatttccctgaactctttccgtgtcgctggggggattttgattgtgagtattgcgatgacgatgattagcggtaaattgggcgaacataagcagaataaggaagaaaaaaatgctgacctgtctgaatatgaaaatatcggggttgtgcctttagcaatgccgattatggctggacctggagcgataggttcgaccatcgtttggggaacacgttatcatacttgggtagatctggttggatttagcgtggcaatcatcttatttgcaggtatctgttatattttattccgcttctcagcccctttggtgaaacgccttggtaaaactggctcgaatgttgttactcgtattatgggcttaattctaatggcattaggtattgaaattattgtagctggactgagtaacttatttccaggattaacggcaattcattaaaatggcatctattcaacgcattatgcaatttatcaaaaaagggctttttgtgaccgcttgtatcgtggggtttgttgcctgcgatccagaagagaataacggttccgttagacctttgcctaatacagaactaaccaatgttttaagccgtgcaatttacgcaaccgagctacaattagaccctcattttgtcagaatatctgctgaggctggggttgttcgagatctatttttaggcttgatggcgtttgatcctaaagggcaaattcagaatgctgtggcaaaagagtggtttagtgaagatggtaaaaactggctgtttattttagatgaaaatgcgaaatggtcgaatgatcaggcggtgacttccgcagattttgttgcaagctggcaacggttgagtgaccctaaaaatgcctcaccactagcacattatttagtctatatggggattgttaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgagctgtcttggctggtgaattaccccctgatgctttgggagttaaggcgttaaacccttacactttacaagttcagctggaaaaagcgaattatcaactgcctaaaatgctggctcattctgcattgttgccaacctatctaggtcagaaaccaaactcaatggatctcgttagtaacggtagttatcgcgttgagcatcttgaaaaaaatctgttgcaactgaaagcaagggataaaaatacgcctttccaagtagtgcaatatcatttaattacctcagtacaaaatccaagccgtttcgatattattgaaaatccgttggaaaactatcatcaacacgaaaaacgttttgctcgcttgtgtaattacttttatgaatttaacttcaatgatccgttatttgctcagaagccaatacgtcaagcagtgcgagcaatgatttccccgatagaaatcagcaaaggcaatggcataccttcacatttaatgataccgaaacagctatttagtgaaatgggacattcactttctcataccaatgtagagcagttattaaatgaacaggggatccattcaggcaatccgctaaaattaaccttgagttatgataaacaagggcaacatccacaaatcgcagagcgaatgacgagagctttagggcagtctgacctatttagagtacaattacaagcggttagctgggaagagttacttgcaaaacgagagcacaaagatttccaactcattcgttcaggctggtgtgcggattatcctgatcctgtactctttttaacgcaatttcatagccaaagccctgataataaaagtagttatagcaacgctaaagtagatgaactgttgttacaattacaagaacagcctttagatacggctcaaaggcaaagaataatcgctacaatagcacaccaattggaagaagatgtcgcaatcttaccgctttttcaatatcaacgccgaatgagcattgctccaacaattcaaggctttgatgaacaaaatgcaagtgaaactatttatagcaaagatttaactcgacaataccataaggataagtaaatgaaccaacttaccgaacagcaattagctggcattaaaagcgttttacaaggttttcaacattcaaccttgcaaaaagatttaatcgcattaaatgcgttaaaaaaagccgaattaggcggtgggattttacgtcttgaatttacgctaccttttgcgtggaacagcggatttgaacaattaaaggcaacaacggaagcaaaactgaaagaagtcagtggtgcaagcggtgtgaaatgggttttaaattaccaaattgccaccttaaaacgtgccaatagtcaccctgcagtaaatggcgtgaaaaacattattgcggtcacatcgggtaaaggtggcgtaggtaaatctaccacatcggtcaatcttgctttggcacttaaagcacaaggggcaagggtgggtattttagatgcggatatttatggcccttcaattccacatatgttaggcgcagcaaaccaacgtccagtgtcaccagacaataaacatattaccccgattgaagcccacggtttatactctaattctatcggctatttaatggatcctgataacgcaactatttggcgtggaccaatggcaagcagtgcattaagtcagttactccaagaaacgtggtggcctgatttagactatttggtcattgatatgcccccaggtacaggcgatatccaacttaccctttcacaacaaattccagtgacaggggctgtggtggtgactacgccacaagatattgcgttgcttgatgcgatcaaagggatcgcaatgttccaaagagtatcggtgccagtgttaggtattattgaaaatatgagcgtacatatttgtgcaaattgcggacaccacgaaaccattttcggcacaggtggtgcaaataaagtggcagaaaaataccaaacgcaagtgttaggacaaatgccattacatattcgtttacgtgaagatttagataaaggtacgccaacggtggtagcagatcctaaccacgaaatcagccaagcctaccttgatttagccttaaaagtttcgactgagctgtattggcaaggtagtgtaatcccatcagaaattatgattcgtgaagtgaagtaatcgtgatatcaaaataggagcttataacaaaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttataagctcctatcatatctaccactgataacctacccccacagagccgcccatttcaccactagtatttgcattaccttgtaatttaaggatcagcttgccgttatctgatgctcttgagtaacccactgctaatgcagattgacctttgaaagtccccgctgataccgcaaccattgatttaccagggatataaacctgtggtaaacctgctgcggcgttagaacctgcaatacccgcacgcagagctttattattacggttgatcttattgtgaatatcgcccatatgcaccttgtgctgagatattaagctatacaactggctaccattaatcgcatcggtactttgctcagagattaaaccaggtgcaacgttttgaatacggcgagtttccattttgccatcactgtctacattacccacgctcaccacgcctacaacttcagttgctttaccgccggcataagcgttatacacaccacctgttacttggctttctaaagcacctgcccccgcagtggttgcacctgctgccacatagcctgagtttgtacccaagaagacagagttgctggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgagtaacacaaaactaaagataaaataacaggaatttttcgtttttttgaaaaagatgagttaaatattgatatgattatacttactttccttaaaatactaacaagctgtgtttctatactcttctcaagaaaggatcaataaatgacaatacatctctcttttattgagcgttatcgccaattaattcaaattcctaccataagtagcctgaatgaaaaatatgacatatccaataaagcattgattgagttattggcttattggtttagtgatttaggatttaaaacggaaatcatcgccattaatggctctcatcaaaaatataacttacttgcaacttatggcaaaggagatggtggcttattactggctgggcacacagatactgtgccttatgatgaggggctctggaatttcaatccttttcagcttacagaaaaagaagggaaattctacggattaggtactgcagatatgaagggcttttttgctttcgtggttgatgttctcaatcaaattgatttagcaaaacttaaaaagccattacggattttagctactgcggatgaagaaacaacgatgcttggtgcaagaaccttttcacaacatgcacatattcgcccagattgtgcgatcattggagaacctacttctcttaaacctatccgagcacataaaggccatcttgctcaaacagttcaggttattggtaaatctggccattccagtaatcctgccaatggaattaatgctattgaaattatgtatgaggtggtgggtaacttacttcaactcaaaaatagcttaaaacaaaaataccataatgagttattctgtgtttcttatcctaccctcaacttcggaaatattcatggtggtgatgccctaaatcgtatttgtgcttgctgtgagctacaactagaagttcgaccattacctaatttagccatccaagatgcagaggatttagtgcgacaatatcttgcgcctcttattgagacttggggggatcgcattcaagttaaagccttacatgcgggtattcctggctatgaatgcgaacattccgcccagatcgtaaaggtggttgaaaaattattaggagaagaatgtaaagcagttaattactgcactgaagcaccttttattcaacaactctgcccaacactaattttaggccctgggaacattgaacaggctcaccaacctaacgaatatttagatgcaaaattcattgaacccacaagagaattattagcaaaattaattcaccatttttgctagataaaaaaagcccctgtacggggcaactcttttgatctaattctaggaggtatgaattactgttttataaaaggagacaaataaaacaagaccaaaagcaaaaaactaaaggaggaaatcgtttggctcctcctgctggacttgaaccttattctttactacatatagaacaatttgactgtttaagcagcttcatttctcgtatagaaaaatttaaaccatcaattactaaaagccgtccagacaatatttgaccaatattaagtaaaactttaattgtttctaatgcttgcaagctgccaataataccgacaataggagcaatgaccccagcttcaacgcaactaagagtgttttctccaaacaactgacttaagcagtgatagcagggatcttgtttttggtaaagaaaaacactcacttgcccttcaaaacgaatagctgagcctgatacaagcggtttctttacattaaaacaaattttattgagtgtattacggattgtcacattgtctgtacaatccaaaactacatcaaattggggaatcaatttagcccattcatcttcttctaaatacgcattaatggtttcgatttgaatatggggattcagttcatgtaaacgctttttagccgattctacttttggcatgccgatagttgcatcagaatgtagtatctgtcgttgtaaattagaaagtgaaaccgtatcaaaatcaactaaggttaaatatccaataccactgcttgctaaatactggctcgctgcacaacctaatccacccaatccaacaattaaggctcggcttgcttttaacttttcttgcccatcaaaatcaatgcttttcaatataatctgacgattatatcgtaatatttctgaattcagcattgtcatttaactttatatcccttctgctccaacatttgcttaagctgatctcgattatcaccttggatttcaatcacaccatctttaactgagccaccacagcctgttttgcgtttaagttcagaagctagtgccaccaaaccacgatcatctaaatcaacacctgtaattacgcaaacgcccttccctttacgaccacttgtctggcgttgaatacgcacaatgccatcacctttcggacgttcagccttcggtttttctggtgtaattcgaccaatttctgtggaatacactaaagtcatttgtaaaatttccttctacacgaaccgcttattaggcgatagattgattaattgattttaatactgcaagaggatcagtggcttgggtaataggacgaccgatcaccaaatagtctgatcctgtttcaatcgcttgttttggagtcatcacacgacgctgatcgccaaaatcactcccttcaggacgaatacctggcgtgacaagtttaaaatctttgccacagtgagttcttaatacctcaacttcttgtggagagcagactacaccatctaaccctgcacgttggcacaaatgggcaagacgaataacttgttccatcggtgacgcattaatcccgatttgtaataaatctaaatcttccatactggttagcacagtcacaccaatcaataatggtgcatctttgccgtaaggctctaaaatttgttttgcggtttccatcattcgtaaaccgccgcaggcgtgtaaatccaccatccacacccccaaatctgccgccgaatgcacggctcttgcaacggtgttaggaatgtcgtgatattttaaatctaaaaagacatcaaatttgcggtcttgtaactgtttcacaaagtgtgtacccaatgtggtaaacatctctttgcccacttttaagcgacaaagggacggatcgacttgatcaacgaaattgagggcttcggcttctgtttcatagtcaagggcgacgataattttgttgtccatttaaattctcctatgttaaatcacttctgtaatactttgcatcggtttaatgctttcccaagttcgacaagatgggcagtgccaagacaagcggtaactttgataaccacaatgaatacagcgatattgaaatccctgtttaattcgatcaccgaccattttatgtaatagaactaaactctctttgcctctgccctcctccgcttcatttacttgatagtaaataaaacgatggaaagtcattaaacttgggaattgtctaacttgttgataaagccgtgattgtgcggcttctacaccatctttttgttcaataaattcagctaacgccaaatcaacactgctgttgtgtttaatttggttggctttgattaagaacagctcaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagctcaaaattattttgttcatttaacgcaatataacattgcttaattttatgtaaaacttcgctgatgtagttcggttcttgttctaataccgcttcaaaatagcgtaatgccgttcgcatttcttgtttttcgaagaaaaaatcccctaagagtattgaggctcttgcacagtgaggaacgtaagaaagggctttttgtaatgctgttaaaaatgctttttcatcttccgatctgaccgcttgtgcatattcacaataatagtgagataaagggattttatccatttcaggctctattctaagccttttttcagcgacattaatcgcttttttccattctcgtgttttgtgataaatcacagcaagctgacttaatgaattgactgcaaactcaggttcatcaagcaaggtaatatagtaattttctgcccgatcataaaaacctgcagccataaaatctttggcaagttgttgttttgctagtaatttttgttcaaaggaatagtgaggactgttttcaatcccttgatgaatccgcaaagctctatcaacttcccctcttgatcggaataaattgcctagagtaatttcggcttcaaattgtgattctgttgaaatctggttctcagactcctgcttttgtagcatagaaaggaaaagatcaaccgccttttcctgctgattagataaaagaaagttcaaacccgtgacatagtcacgggaaaatttgttattaattgcatcttgatccttttttgcactacgttgccccatataccagccatacaaggctgcaataggcaacaaaaggaacaacaattccagcattattcagcctttggtaaagtaagttcgctaatttgttgagcttggcgttttacacggcgatttaaggcaatattttgtaatttcacttttaaatagaaaaatcccgtgattaaccaacctaaaattaaaccaaatccaaacaaaatggcaacaaggctagataaacgtaattcgctttttgcgatgatgtagttgaatgtaataagctgatcgttatttgccccaatagtcacggcaacaagaatgatagcaagcacaataatgatgcccaaaatatatttcatctgcgtatctccattattacattagtttataaaaaaacgacaccccacatagtgtcgctttcagagaattaagctaaatcaacacgttctttcagttctttacctgctttgaagtgcggaacatacttagcatctaacttaacgctttcgcctgtttttggattacgtccaatacgaggctgacgataatgtagagaaaaactgccaaagcctcttacttcaatgcgttcaccttgttctaacgaccccataatctgttctaaaatttcttttacactttcatcaacagatttaactgatagagagggatattgagctacgagatttgctattaattccgatttagtcatattttctccttatgcgataggtgaagcggatatgctttcacatatccgcttacgaagagagtaaattactcgccttttgctgctttgaatgcttcagccattgcacttggaatagcctcttcttgcttattcacttgtgcaagtgctgctgattcttcagcttcgtctttcgcacgaatagaaaggtttacaatgcgagctttacgatcaacacctgtgtatttcgcttcgatttcgtcacctacagagataactgttgtgatgtcttctacacgatcacgtgttgcttcagctgcacgaacataaccttctacaccgtctgctaattcaactttaacgcctttagtatcaatttcaaccgctttacctttcacgattgcaccttttttagtgccttcaacgaagtttgtgaatggatcagattctaattgtttgatacctaaagagatacgctctttcactgcatcaacttgtaatacaacagcttctacttcgtcaccttttttgtagttacgaacagcttcttcgccagtcacattccaagaaatgtcagataagtgaactaaaccgtcaatgccaccttctaaaccgataaagataccgaaatcagtgattgatttgattttaccttttactttatcgtttttattgtgagtttcagcgaagtgttcccacggattaggtttgcattgttttaaacctaatgagatacgacgacgttcttcatcaacttcaagtaccattacttcaaccacatcacctacgtttactactttagatgggtgaatgtttttgtttgtccagtccatttctgaaacgtgaactaaaccttcaacaccgtctaaaatctcaacgaaacagccatagtctgttaagttagttactttgccagataatttgctgtttactgggtggttttgtgcaatagctgcccacggatcttgacctaattgttttaagcctaatgatacacgcgttttctctttgtcgaatttaagtactttaacagtaacttcttgacctactgcaacaacttcacttgggtgtttaacacgtttccacgccatatctgtgatgtgtaataagccatcaacaccgcctaaatctacgaatgcaccgtagtcagttaagttcttcacagtacctttcacttcagaaccttcaactaagttcgctaatacttcttcacgatcagcagagcttgttgtttcgattactgcacgacgagataccacaacattgttacgtttttggtctaatttgattactttaagttctaaagtttgaccttcaagatttaaagaatcacgaactggacgggtatcaactaatgaacctggtaagaatgcacgaacaccgtttaactcaacagtgaagccaccttttactttaccgtttacaaaaccaacaacggttgcttgttcttcgaaggctttctctaacgcagcccaagactcgttacgtttcgctttttcacgagaaagtttggtctcaccgaaaccgtcttctactgcatcaagagcaacatcaacaacatcaccaacttgaacttctaattcaccttgtgcgttgaaaaactcttcagcagggatcgccgattctgattttaaaccagcatctacaagtacatagcctttttgaattgcaactacagtacctttaacaatagaacctaaacgggtttcttgaccttttagtgattcttcaaatagttgagcaaaagattcagtcataattaatcttcttaaataaaataaaacgtccatttagcatccatctaaatggggttagggataacaacttaacaatcctttgttaagcaaacaaaattacaatttttgagcaatataatccaacgcttgttgaataacttcctcaatggataaatgcgttgaatctaaaatcatcgcatctttagctggaacaagaggtgcaacagggcgatttctgtcccgaaaatcacgctcttttatctcggctaaaatctcgtcaaagttagcattaaatcccttttcttgcaactgttttacacgtcttcttgtacgttcttctgcacttgcatctaaaaagaacttaatttcagcttctggaaagacaaccgttcccatatctcgcccatcggcaattaatcctttaggacttctaaaatctctctgacgttgtaacaaagcctcacgcacttgaggataaaccgcaatttttgacgcattttgacccgcttgtgccgtacgaatttgatcgccaacgttttcaccgtccaaaatgacctgaatttcattattctcaggcacaaatttcacattaagatttcgcccaagctgtgcaagagccgtttcactctcaaaagcaatcccctgttttactgcagccaatgctaaaatacggtaaattgcccctgaatctaaaaaatcaaagcctaatttctctgcaagggcgtgacacaaggttccttttcctgcaccacttggcccatcaactgtaattacaatacccatatttatcctttataactctggaaattcaccaataaccacttcaacttctttctgtatgccttgacgagaaattaatacctttaccttactatttggtttcatttctgcaatcaattccatcatttgagctggagtttgggcttctgtatcatttaaacgtaaaatcaaatcaccagctaaaatccctgctttatccgcaggtccaccttcagctactgtagtaattaagatccctttttcaccgactcctagctgtttagccgtatagtacaacgagctattaacaccaaaatagcctcgaataacacgcccgtcacgaataattttttccatcaccttatttgctaaggaaatcggaatcgcaaaattcaatccttctgccaattcatcactattttttcctaaacttaaagtgttaatgccaatcaactcaccagccgtatttaccaaagctccgcctgaattacccttattaatagaaacgtcagtttgaataaagttttgccgacccatttcagataatgcattgcgtcccgttgcactaataatgccttgtgtaatactctgccctaagtttaacggattgccaattgctaaaaccacatcaccgattttagccatgcgttttgaattttgaggaattgtaggcaagttttctgcttgaattttgagaacagcaagatcagttaaggtgtcagaccctaccaaagtcgcactcgaaatcgtccccgattgcagtgccactaaaatttgatctgcattttggataacgtgtttattcgttaaaatataacccgttgaggtcataatcacgcccgatcccaaattgtttacttgtaactcccctgtatcagaatgggtagaatcaaaggcccgattataaacattgactaccgcaggcgacgcaatttttactgcatcgtgaaagctgataatctctgtttgagtgcttttgtttaaccaaggggcaacataaagaatcaagccagcacaaaaaagcccaaaacctaccgcttgtgctatttttttgacgatcacatttgctccttgttagcgtagggacacactgcgtgtgtccaccaaccattattaataaaaattttgaacggacacacgcagtgtgtccctacattttatataaatttaattacagcgacttcgataattttttcaaataatctttaaatttaccgccgaatttatcgtggttcaaactgtattctacaaaggcttccatatagcctaatttgtcaccacagtcgaaggttttacctgtcatatgaaaggcatccacctcttgttgttcaatcaacatatcaatcgcatcggttaattgaatttcatcacccacaccgaccggtgttttggcaagtaaatcccaaatttctgcagagaagacataacgtcccacaacggcaaaattagacggagcttcttcaatacttggtttttcaatgatattagcaatcttcgctgtacctgcaggttgtaattctgcaccttggcaatctacaataccatagttactcacattttctttcgccacaggtgcaaccataatttggcttttgcctgtttctttgaaacgttgaatcattgctgctaagttttctgttttttgatctgcagtaaaatctgccaataacacatcaggcaataccactgcaaaaggctcatttcctaccacagctcgaccacataataccgcgtgccctaatcctttcgcttgcccctgacgaacgtgcatcaaggtcacatctttaggtacaatcgaacgcacttcatctaatagctgacgtttcactcgtttttctaacattgtttcgagttcaaacgatgtatcaaagtggttttcgatagcgtttttagatgaatgagtgacaagcacaatttctcttactcctgcagccacacactcgtttacaatatattgaatcaacggtttgtctgcaatggttagcatttcttttgggattgctttggttgcaggaagcatacgagtaccaagacctgcgacaggaataatcactttcatagaaaaatccttaatatatttagataaagtaaaccgcctaccttaagtaagcggtctgttttgcacaaattttttcaaaaaattgaacactgcgtttcaatttatctgtttgtgacatttggttccagactcaaattcacattgcgttagataaaaacctcagtaaatatcaatctaccttattccgagggattttcatctgctaacactttgattctttgataaatttcttcacggtgaaccgaaatttccttaggtgctttcacccctaatttaacttgactaccacgaatacttaggacagtaatttctacatcatcaccgatcaataaactttcgccaatcttacgggttagaataagcataactatctctccttttagatttaatcagggcaagccaaagtcattctaacttgccccttataattagagttttgcttgaatccaattcgtcgcaacattgagggcttgggttatattttctggttggctaccgcctgccattgccatatcagctctaccaccgcctttaccgccaacttcttgagccattaacccaacaagttcgcctgcatttactttgtctgtaagatcttttgttacacctacgatcaaattaactttttcatcagtttgtgttgcaaagacaatcaccgctgaacctagttgatttttcaagtcatcgaccatcgttcttaatgcttttgcatcaacgttttctaaacgttgaacaaccacattaaccccgttgatttgttgagcttgttttgctaattctccaccagcttgagctgcaagtttatctttgagctgttgtagctctttttctactttcttgcttttctcttgtagctgctggattttctcaacaaggcttgccgtatctgcttttaataactcagcactttggttaagaatttgttgttgctgatgtaataagccgattgcattttcgcctgtcaccgcttcaatacggcgaacacctgcggcaaccgcaccttcagataccactttgaataagccaatctcacctgtttgtttaacgtgagtaccaccacaaagttctacagaaaacgctgctgttatatctacaacgcgaactctatctccatatttctcaccgaaaagtgccatcgcacctttttgcttcgctgattcaagatccattacttcagttgtaactacaatgttttcacgaattttcgtattaataatacgctcaatctcttctaagtcagcttttgaaatcgcttcaccttgagaaaagtcaaaacgaagtgaattttctgacacaagagaacctttttgtgcaacgtgatcacctaacacttgacgaagagccgaatgtaataagtgggtcgcactatggtttaaggtaatagcgtgacgacgtgtcgtattcacttctgctttcaccttatcgccgactgataaagtgcctgaagctaattgaccaatatgcccaaagacttgactatatttttgcgtatcattgacttcaaaattgcaaatttctgaagcaatcacaccgctatcaccaacctgaccgcccgactctccatagaaagcggtacgatccaagacaacgactgcattttcccccggttgaatagcttcaaccgccttaccattgctaaataacgcaacgacagtcgcttcacattctgtgacctcatagcctttgaactccgttgagccatcaactttaatcacataattgtaatctgtaccaaaattactgcttgcctgcgctcttgcacgttgagcttgcatttcacgctcaaagccagcttcatcaatggtaatactacgttcacggcaaacatctgccgttaaatccagtgggaaaccataagtatcgtaaagtttaaatgccacttcacctgataaaaccttattctctactttggctaacgcatcttctaataacgccaaaccacgctcaagggtacgtgcaaactgatcttcttctgcttttaacgctttctgaatatgcgcttgtttctgcgtcaaaatctcgccagcctgccccattgcttttgcaagggttggcactaattgatagaagaacgctgatttcgcaccaagaatgtttccgtgacgcaccgcacgacgaataatacgacgcaacacataaccacgaccttcatttgacggcatcacaccatcagcgatcaaatacgcacaagaacgaatatgatctgcaattacgcgtaacgatttattgtctaaatctgtcacatttaacaaagaagcaatctctttgattaacgcttggaaaatgtcgatttcgtagtttgaattaacgtgttgcaacaccgcactgatacgctctaaacccatacccgtatctaccgacggcttaggtaatttctttaaagtaccatctgcttgacgattaaactgcataaagaccacgttccatacttcaatgaaacggtcgccatcttcttctgttgagcctggtggacctccccaaatatggtcaccatgatcgtagaagatctcagtacaaggaccacaaggacccgtatcacccatttgccagaagttatctgacgcataaggcgcgcctttattatcaccaatacgcacaatacgctcagcaggcacaccaatctctctattccaaatatcataggcttcatcgtctgtttcatagactgtcacccacaatttctcttttggtaacgctaaccactgcggtgatgttaaaaattcccacgcaaatgcaatcgcatcgggtttaaaataatcaccaaaactaaagttacctaacatctcaaaaaaggtatggtgacgagcggtataacctacattctcaaggtcattatgcttaccgccagcacgcacacagcgttgagagctggttgctctgttataactacgcttgtctaatcctaagaacacatctttaaactggttcattcctgcattcgtgaaaagcaaggttggatcattttcaggtacaagcgagctacttggcacaatcgtatgccctttgctttggaaaaactccaaaaaggcttgtctaatctctgaagttgttttcattaaagtcactcaaatggatataaaaaactgtatatctatgtttttactaaagtatattagtaattcacacacctattttacacatttttttcaatacttgtattttttactgcataaattattgacattaagtcaaaaaatagaccgccagagtaactgaatgcgataactcagctacacaagcggtcttttttcacgttttatttaccaatcaatagcttgagttattcacttgctaaaggaacaacgagcatatctaccgttacactgttcatcacttgacgagtagaagacataaatttgctccaaaaatcctggtgatgaccagtgaccaataagtccacttgatactcctctaccgcttcttccagcacttgactaaaatcaccactaccatttaaacgttcagtaacagggtaagtaattttaccagagagttcctctaatgctttgatcgtttcttctgacacagaatcttgaacagacgacatattaatatcaatcaacccagtgtagagatccgaaaagttcacatcaacgtggataacggataattttgcattacatttttcagcaagactcgcacctttacgcaataatacaaggctttcttcagagagatctacggcaactaaaatatgtttatacataatatactccttgttgtgtttagtaataactgagccatctcagctttcgagctaatactaccacactccttgtagttaaaatttgaactacttctcaattttgaaaattctttgaaaaatttgtcaagttatttgcatttcttatctaactttttaatctaaattaaaaagatatcgtgttaaaaatcataactacaaacaatttgatataccaatatttatttttgtgatccctgtcgaaaaacattatttttctacttttctctcttttcatcattggcatactgtaatctctttgattaggtatgttgatgatgtctattgatcgtgtctgtttaatgctctttttcggtttattgccgttgattgttctgcctgcttcgtggcttggctatgtggtggtattttctcttgcccttgcattatggggagtatggcgtgggaaattggggatcttgctgttgggtggtgtgttagcggtgagttacgcccagattatgcaacttgcaaaaaaacatcaggaacagaccgctgttaaggtgcaagagcgggtgttagtgaagcaaattttaaaacagcaagaatatcaaactgccgttgtagagcgtgctaatggggactatgtttatgtcaattggcaagctgatgagccattgatactggaagcaagttataacgcggaactggcattgaagcctttgtccgctcgcttaaatgatggcaattttgatcgacaaaaatggtatgtggctcaacatatctcagcaacagctacggtcaaaaaagcagtaaaagtgaacgaacaacaaggcttgcgtgcaatttggcttgatcgtatgcgagaacagaccgccccttttgcaacgcaagggttactgcttgcccttgcttttggtgaacgggcttggttaagtcaaagccattgggagatctttcagcaaacaaccactgctcatttgattgccatttcaggctcgcatattgttctggtttatctgttagccttttggacggcgaaagctgggcagtggttattattgcgatttcgttatctgaaagcggtggggttgtccttgtattttgcaaggggagtagggtggtgtgtggcgttgggatatagttttttggcaggcttccaaattccaacggtacgggcaatggtggcgatttcattggttttgctggtgcaatatgctcgtcgtcattatacgccttggcagttatggcttcgtggtgtggtgctattagtcgtctttgatccgctgacgttactttccgatagcttttggctctctgttttggctgttgctagtctaattatttggtatcaggcttttccactcaagcggtttgattttgtcaaaaatatgcaaaatcgagtgatgaagttgctgttagagttgtttcatctgcagttaggcatttggctagtgttctcgcctattcaactcagtttttttgatggcacatcacctttcgctttgttagccaatttgatcattgttccactttatagctttattcttatcccattgattttatttagtttattaacagataacctatttcaaacttggtggctttgccatcaacttgcagagtgggggattgattggattgagccattttcccatcattggctctatttaagtgtcgatcaacaatggggattaatatgccttaatctattgattataataggattatatggtgtttttcagcaacgtttttctctctattatgggttagcaacagtggcattgcctttagcattgtggatcggatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggatttcattttgtaaaagatacacttaaaccaccacttgtaaaatgggtgaattttgatgtggggcaagggttggcaatgggattgatttatcaacaccaaggtaaacagaaagccattctctatgatacaggcgttgcgtggcaaggtggcacaatggcggaattggaaatactgccctatttacgccgtgaagggatagtagtcgaagctatttttgttagccacgatgataacgatcacgctgggggcgttttgccattactacaagcctacccaaatgcacggttgatcctttcgggtaaaaatcattatagtaaccaagtcgccgagccttgtatagcaggcaatcagtggcagttcagcacaatgcaccttgaagcgatttatcctttacaactgagcgagcgagctaaaaatgaacactcttgtgtattacgagtgtcgatagggcaatatagattgcttcttactggggatagtgggattgcggaagaacgacaatatgcaagccagatcggtaagatcgattttcttcaagtaggacaccacggcagtaaaaccagtaccagtcaaacattgctcgctcacacccaacccacttgggcgattatttcggctgggcgttggaacccgtggaaaatgccaaatagtcaagttattcaacggcttgagcagtatcaagtgaagtggcttaatactgctcaagtgggaatgatccaagtcgatttttattcagataattacaacatttccaccgcaagaaaccgctttagtccttggtatcaggggataggggcaaatgaataaattgagttttgtagcctgcggataagataattttacatcaacgatacccattcggattgttcttttgccaatgccacatatctttcatcatctgtggcaaatcacattcagttttccagcctaacttttcccacgcttttcaaatcacttgggtgaactccaactggattgaaataacgtaataccgctgcagagaattgtggattagccttaacggtatcttctaaaatccgttccaccatatattttgatatgccatagcaactgtttatcgactatatctcaattagataagcacccaaataataacattacttggtttcttatctgaattgaatctatattaattaaactaaaacacctttttaaacggcttcacaatcacttcgccataaacccctgcttccacataaggatcttggcttgcccactgttttgcttcttcaagtgaattgaattttgcaataacagttgaacctgtaaaacctgcttcacctgggttttcatcatcaatcgctgggtttggacctgcggttaaaaggcgatcttcggcttgaagttgttttagacgttcgaggtgttttccacgcacggctaaacgtttttcaagggtgtttggtatgtcttgagcaaaaattacatagtacataatgtcctccattaaggttcaattaaagctaaggcttggtcaagatctgggttgttttctcgtgggataacacgaggtttgccgttgctatctacagcaacaaaggtaaagagtgcttcggtgacacagtggcgttctctcattccttcatacacttttttgatccatacttcgactttgatttgaagtgaggtgcgtccaactttggtgcatttgccgtaacagcaaaccacatcaccgactgatacaggcagtaagaacgacattttatctactgaaacagtcactactctgcctttaactagctcttttgctaaaatcgcaccgcccatatccatttgtgacattatccaaccaccaaaaatatcgccgttggcgttggtgtctgatggcattgcgagggtgcgtaaaattaatgtgccttcaggctggcgtttagtttgtgtttccattattttcctctttttgttctagttgttttaggtgagggtagagatataagccagtgccgataacggcaatgaggcttaatcctgttaaaccgaacaccttgaaatttgcccaaacatcgtcagagaagaactcactgatgatgatgttgatgatcatacagaagatgaaaaagcctgcccaacctaaattgagcttttcccatacgttttgtggcagtttgagttctttgccaagtaacatttggataagaggctttttgaatacgtattggctaacgagtaacgctaccgcaaaaatggcattgacaatggtgactttccatttaaggaatgccaggtcgttaaagtaagcggtaagtaaaccgaagaaaacgaccgctattcccataatccattgatttttttcgatttttttataaagcaactgtaaagcgataaattgaaccacggtagcggcaactagcactaatgctgcttcttgtacgccataggttttatagacgacaaaaaagaggatcagtggaataaattcaagtaattgtttcattgtcaatcctattggcgatacacttgatagaaacggaaaccaaatacaacaacaaataagctgataaaggctccgaccacttgtgaaagaataatcccgacatctccgccaattctaccgattaatgaacctagcaagctagggaagaaataacttaagatacaaaataggaaaagcggaaacattctgcctcgacttaatccccaagtaaaacgtagggtttgcataatgctttgtggagcttcaagtaaataggcatagacgacgaggctaagtttgacaaacagatagatacccgttgccatcagcggtaagatcattatggcaagactgccttgttgcccgacggtgccaccaaatgagatcccgattgaaagtggcattaccataaaaatcgtcagtaaaatcaccgggaaaaaggctttgagagttgccccgatattttggctgaaatgttgataagtgccactattgatagatttaatgtttaaaatcaataagatattgataaatacactaatcaaagcagaaataatggttggggcaagttgtgatgtaagtaaagttaacatctcttgatttgatgtatttcctgcctgtatttctactctaggaaagagaaaaatggtggataattgtaataaaattaataatgcggtacccgtaagcgtaaagctcccttgattacggataaaattccaactatcttgtaacaaacttggaaatttaatcggcatttgacttccttaaattaatgtggtgaaaattcaacataatacagtatggtatagcatttgctacatcattctgcgtaactatatggaaagtatagcaactgttgtgataattcgctattgtagattttgtagagatgagtagaatgtaacttgaattatttaacgataaaggcaaattatgtatcacaccttgcaagcaggacagcgttacctcaataccttcccaaatcagaagaaactcggactgtttatgcccgattatcgtttaatccgcttagttaaattttcgtcacattttatgcctgcttttgcttgttttgcgttagtttggcaatactttttccacgatcctgaacaatccattctagccaatgcgaccttaacggcgttgtttgcattgagtatcccatttcaagggttattttggcttgggcgacgggcgaaatcgccgctacccttgggattgttgcaatggtatgaagaacttcgtcaaaagttgattagtgagcaacataatatcgctgaccaagcgtttccttcttatcaagattttgcgaatttgttgcaattagctgaaaagacgtggggacagagctattttgatgagttgtagttaacatactgatttttctgctcttcccttctctttctaaaaaaagcactgattttttggctacactcattagccatcacgccacctcgaatttgcagaaaatggttcattttatagtcttcaaaaagatgaaagcgagagcctagcgcccctgttttgtaatccgaggctccaaataccaaccgcccaatacggctatgtaaaatcgctccagcacacattgtacaaggctctagggtcacataaagggttgtatctaataggcgatagttttgtatctgttgcccagccattcggattgcttgaatttctgcgtgagcggttggatcagagagaataattgcacggttccacccctctccgataatattgcctgttttatcgaccaacactgccccaacgggaatttccccttctgcttcggctttatctgcaagggataaggcgtattgcataaagtaaacatcctgttcggttaaggttaaatcgcaatgggattgggtgggttggataaacataatttaattaaaatggtagggacacactgcgtgtgtccataaatcacaattttaggtacaagtagcggacacacgcagtgtgtccctacgcatcagattatcgacgaccacgctcgttaaaacgtttttctttaaatccgccttctttgcgatctttaaagccacgttcttcacggcgaccatctctgccacgacctttaccacgtccgctcttatcttcataagggttagcattagttgcactgcccacaggacctaagaaagacatttgcattggtttgcttaacactcgtgctttctgtgcgaaatgttgcactaaatgtttcggcataccctgtggtaattcaatggttgagtatttatcgtgtaacttgatatgtccgatataacggctgttaatatcaccctcgttggcaatcgctccaacaatgtgacgcacttcaacaccatcttcacgaccaagttcgatacgatagagatccatcgcaacgccgttgttatcacgatgctcacgaccgccaccacgacgttccgcagaacgtggattttcacgtcctttgccacgctcagcacgagaagggcgaatttcaggatctggcggaagaataagtttttgtttttcttgcaacaacatcatcattgctgcagctaattcttcgtgatcttggtctgccgtgaatagatcttctaataattcacgataaagctctaaatcgtgatgttctaattgtaatgaaatgcgtgctttaaatttctcacgacgtttttccattaaaatttcgtgatttggtactggcacttcatcaatcggcttcttgattaagtgttcaatgtttttcaataaacgacgttcacgcggctctacaaataataatgcacgacctgaacgaccagcacgacctgtacgaccgatacggtgaacataagattctgcgtcaagtggaatgtcgtagtttactaccaaactgatacgctcaatgtcgataccacgagccgccacgtccgttgccacaatcacatctaaacgacctgattttagtttttccaatgcttgttcacgcgcttgttgggtcatatcgccgtttaatgcagcagcacggtagccgttacgctcacagagttctgcaatatcaatggtgccagttttggtacgagtaaagataatcgcagcatcaaactcttctacttctaagaaacgcaataacgcatcatttttacggaagccgttcactaaccagtaactttgtgcaatatctggtgcagaacgttgggttgcctgaattttgacttcttgcggatctttcataaaacgtttggtaatacggcgaattggctctggcattgtggcagagaaaagtgctgtttggtgatcttcaggcagttccgccataaccgtttcaacgtcttcgataaagcccatacgcaacatttcgtctgcttcatctaatacaatcgcttttagcatagaaagatctaaggtaccacggcgaatatggtcaagaatacgccctggcgttcctaccacaacttgcgcaccattttttaaagcacggatttgaatatcataacgctgaccaccataaatcgtgaccgtgcgaatacctttcatattcttgctgaactgctcacaagcatctgccacttggattgctaattcacgggttggtgccatcaccaacatttgtgggtgacgctgttctggatcgatttgtgctaataaaggtaaagagaatgccgctgttttaccacttcctgtttgtgccatacctaacacatcacgaccatttaaaaggtgtgggatacaggcttgctggatcggtgatggggttacaaaacccatttcatttacagaattaaggatagattgtggtaagcctaaatcggcgaaagttaaagttgtttcagtcataaaattccaaaaataaagaacctgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggggggatttaattcacgcaaatgaaaaattaaatctaaaaatccccctcaatccccctttttcaaagggggaagtattacacaggagataaaaactacattgttgagcctttaggtaagaaaaataaatagaaagcaaaccaatgctttatataacttgtcacacagtgtaagcggtttgatttgcaaaaaattttgcgaaacctaccgcttgaatcgtcctaatttttcccaacaacaacgggatctgtttgtttcgctctttgatgtaattgagctaattcaaacaacgcaaaacgatactcaacaaagttatatacttgatttgcactagctagacggaaaaggcttttagcctcttcaagctgattcattttgagtgtttgttttgcaagataaaaatatgtttcggttaaaatctctgcataagctaccgtattcggttcagcttgagcaatcatttttaaacgaagttgttcaagagtaaaatcccctagcaagtaagacactaaatgtgtcccccaaaagtcttttgacaaatgcttggcacgttttaacaaatttgcttttgcatcacttgggtttaattctaactcattgaaatataaccataatacacggtaaggatcggacctatctgctttatagaaacgcaataaatcacgttctgcctcagaataacgaccgctataataaaatgctaaaccacgatttaaacgggtatagtcataatttggatcgagttctaacacggcattaaaagcatctatagagctgtcataatcatcttcaagcaacaaatataaacctaaataattataggcagccgccattttaggggcatattcaaccgcttgcgtaaaatcataacgagccaacgaccaaagtcctaaactgtcgtaaataacgcctctttcaaaatgtaattcggcacgttcagcttgacttaatttcgcttcttgcaacacttgcgttaaacgaacaagcattacttcctgttcaaaacgcaactgaggattgagttccgagagaggtaattttgtcggggcaatcatatctgacactctgttcacacagcctgtcaaaaaaatcattaccaaaactaaccagcaaaaacgaagattaaacaacttaaaacgttgtggcattaataaaaccttaggtatttatcattcttaaaatgaagatcccttcctcaatgtgaggaagggacagaagtgattattctgctaattcttgaatttcttcaacaacttccctagcagttgcatcaccattcagatctttcattgttaagcggatacggccttgacgctcgatttctaccactttcacctgaacgtcttgaccaacagataggtaatccgcaacacgttctacacgagcgtcagtgatttgagaaatatgcactaaaccttctttaccaccaaggatagacacgaatgcaccgaaatctactacacgggttactttacctttgtagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactttacctttgtagatcgcattgacttcaacttctgcaacgatctcttcgatacgttccatcacacgtttcgcggcgttgttgtctgttgccgcaattttcactgttccgtcatcatcaatgtcgattgatgtgccggtttcttcggttaatgcacgaattgttgcaccacctttaccgatcacatctttgattttcttcggatcgatcttcattgtatggatacgaggtgcaaagtcagagatttctgaacgtggtgctgggatcgcttgttccatcacacctaaaatgtgcatacgtgcgcctttcgcttgatttaatgcgatacgcataatttcaggagtaatcccttcaattttgatgtccatttgtaatgcagtcacaccttcacgggtacccgctactttaaagtccatatcgcctaagtggtcttcatcacctaaaatgtctgaaagtaccacaaatttctcttcttctttcactaagcccattgcgataccagcaacagccgctttgattggtacacctgcgtccattaacgcaagagaagcaccacatacagaagccattgatgaagaaccgtttgactcagtaatttcagataccacacgcacaacatacgggaactcttctgccgttggcattactgctaacacgccacgtttcgctaaacgaccgtgaccgatttcacgacgtttcggcgaaccgatacgacctgtttcacctactgaatatggagggaagttgtagtggaataagaagcgatctgatttttcgcctgttaattcgtcaataatttgtgcatcacgctctgtccctaatgtcgcaaccgctaatgcttgtgtttcaccacgagtaaacaacgctgaaccgtgcgtacgaggtaaaacgcctgtgcaaatatctaatgcacgcacggtatccactgtacgaccgtcaatgcgtggttcgcctgcgataatacggctacgcacgatttggctttctaatgcggtaataatatctacaatcttgccgcttgaaatggtttcatcttctgcggttaattgagcgataacatcagctttgattgcgtcaatttgttcataacgtgcttgtttttcagtaatacgataagcatcgcccagacgagcttctgctaatgctttaactttattgattaaatctgtatttgactctggagcaacccaatcccaacgtggtttgcccgcttctttcacaaattctttgatgttttcaatcaccacttgttgctgttcgtgaccaaacaccactgcggctaacatctgttcttcagttaagatatctgcttcagattcaaccattaataccgctttgtctgtaccagctaccactaaatctaaacggcttaaacgttgttctgatgtagttgggttaagtacaaattggttatcaatgaaaccaacacgagccgcaccgattggaccattgaaaggcacgccagatagagataatgcagctgaagcaccgatcatcgccactaaatctgggctgatttgtggattaacagaaaccactgttgcaatcacttgaatttcgttgaagaaaccttcagggaaaagtggacgaactggacggtcaattaaacgcgcgattaaggtttcgccttcagatggacgaccttcacgtttgaagaaaccacccggaatacgacctgccgcgtaagtacgctcttgataatccacagttaatgggaagaagtcttgaccttcattcacctctttttttgccaccacagtaacaaaaacggtagtgtcgtccatacttgccattactgctgccgttgcttgacgagcaatagcccctgtttctaaagttacggtatgctgaccgtatttaaattgtttaacgattggagtcatttgaatgttccttatgaatttttggatttgttgttgttttatttcctaaaaattgcgactagcaaaagtaatctcacacatcaaattacttttgatagccgcctcttagaatgcgaagaaataaaacttggctattatacagagattttctgaaaaatcgcctgttatttcggaatttgtgagaaatttataatggtcaagttgatgataaacctaaatctgcttttatttaccttctatatcattatttcctcacttcgttgtctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagtcagagtgagaggtaagaacagcctaaataactttatcatcgtactgaaacaaggctctcccctctgttttctacctattcatacaacactcttccaccccacaacaacccgcagtaatattaatccgcttgttatgataagggtacaaggtgcaacggtgtccgacactgataatggtgctgtttggcagcacttcccgaatggtacggtaaagaatagactccgttggctcatcaagggcggaagttgtttcatcaaggaaaattaattcaggcttgctgagtaaaattcgcacaaaggcaacccgttgcaattcacctggggaaagggtaagttgccagtcgttatcatcatcaagtgcgtggagatatttatccaaacagcatttttccattgcctgtttaatttgctcgtccgttgcttcaatatgtggataacaaatggcttctcgcaataccgcagaaaattttgcctgtaaatttcggtgttctttggcttcgcccgaataaaaggcgatactttcggcgttatctcgcacacggatcagagagtaacggtaatccccttgtagcttctctttattgaaattcaatgcaatcagtgggcgaccgataatcacagaaagtaaggtagcaacaataataaaaatatagataaagaacaccacacctttcgggatttctacaccgaagatcgccaagatccccgatagcccccacaggataatggtaaattcaatggtggaaacgaccgcattaatcaccccatgcactacgtctaacgtaccgccgataaactctgtcgctttggtgaataaatagatcctgcggaaattgcaccgttagttttactgctttgatcgtggtcacgctgacgttctactgaatcaaacgctagactccaattgtgaagaatcggtcctgtttcagtttcaccttgtaattttaagttcccgcttgttgtacgagaaacaaagtccattccacgaatacccgatactctaaaatcaccattttgcttaattgagttaatttgtccaaatgcacctgagtaacgagatttcatatgtccaaagccacctgaaaccatcatattgtaaggcagatcatactcaaaggttgccattgcggttttatcttcggtcgtctgtccaagccaatctgggttaagattaatttttccatttggcgcaactggcattgcaaattttaagttttgcatatcttggatacgagctctgccgccgtctgttttacgcttactttgcatataatctacgccaactcgtaatttctcaccacgataatctgctccaatcgcaatttctttcgctcgctcatcgtaatcgtgacgagccgtatcaccatcacggtatttgccacttacacgaatgccccactctttattcgcaccaaaacgacgacctaaatcgaacgactcttgtaagcgattgttactaaaccaagcaaaaccgactttgttaatatcttcgtccgttgcacgcttcgtttcgatgttgattgatgcaccaacagaaccttcagggggtccataccaaccgttgctgtcgaagcacctttaattaattgagcagatccaaccgctgttgtcggtgtattgtatgcagaataaagccctgctaaaccatttacactaaattggcgtgcaccaagctgtaagccacgaacataaaccccctgtaaggtagcggattcaccaccgaaattcattactgaagcatctgtttttgcaagcacatctacgatatttctcggctctttgtcagcaaaggctttttcatcataattcactacggtaattgcattgctttacagtaattattacattaaaaaagcgacaaagttaaaaataactttgtcgcagattattacatagtattgttttgtaaatttttatttaaagatcacatcatcttttggatcatattttgacgcatcaattggtgaattttcttcaaagtattttttcaacatttcagcatcaataaagcctgtattcacatagcttgggtgttttttcaggattggataaccatcaccacctgctgcacagtaatcaggcacagacactttgtaagttttattgagatcaagcggtttaccaccgactttcacatcagacacctgttttgcagtacgatcaacaaccatagacacgcctgcaaattgtggatacgcacccatatcgacttcttttagggcaacaacattgaggtaatcaattaactctttacctgttaaatcaacggttgcaatcatattaccgaacggctgaacagtaagcagatttttgtaagtgacctcaccttcattgattgaagcacggatagcgccagagttcataataccaatatcggctttcacacgttccatttgtgattgagcaattaagcgacctaaattcgtttggtggaaacggataactttacgatcaccctcaaggataccacctttcacttcaccgactttcacacccaataatttatcgccttcatcttgatattttttcaagtgctcaaatacagctttatcttcagggatctcttcttgatacagtttatactcgctcttaccgtcagctaacttaattttttgtttaagattgacagggataagctcatatttgactagtttcgtttcaccatttttaaattcaaaatcagcacgacccaagaatttaccccattcacctgcttgaacgatccaagtgccgttttggaaatcaggtttacactcttcacccggtgtatatttgagtttaaatacgcctttctcatcaacacaaacggtatcgtgagtatgtccgccgataatcaagtcaaaagcccctttatccaagccacgagcaagagatacatcgcctggagcattcataccgtgttgttcatcaaagtagtagcccatatgagtaagcgcgatacttacatctggtttttcggttttcttcacttgggcaagggtttcttttgcggttttaattggatcattaaacaccacattttcagtcacatcagggttaccaagttttgccgtatcttctgtagttaaaccgattaccgcaaatttcaagccacctttattaagcgtaacataaggttttacaaggtgtttgtttgtttttttgttgataacgtttgcagaaatgaacgggaatttagcccatttttcttgcatatcaagcacttgcagagggaagtcaaactcgtgattacccaacactgccacatcaaaaccaagcatattcaagccttcaatatctggtcttgcattttgcatatcagactcaggtacgcccgtattgaagtcacctgcgtgaagtaaaacaacctcaccgcctttttcagccacttccttacggattttgtcgatcaaggttttttgagcagcaaatccatattcacccttatcatttttccagaaatgaccgtgggtatcattaacgtgtaatacggtaaacctataggttttatccgcttcatacgccatcgcagtagtagctcccataagagccaaagcaagtggagttttattaaatttcatataagctcctttagttttgacagaaataagtgaaaaactcactggattacaaacataaaatcagtaaccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaagccctgtgataagcattgcaacaaaaacagcggcagagccaatatctttcgcacgacctgataattcatgatattcagacccgatacgatccaccacagactctacagcactattgagtagctcagccactaacacaagcaacaccgaaccgactaatagaattttttcgattgccccatcgcctaaatataaaccgacaggaatgagaaaaaaagaaagccacacttcttgacgaaatgcggcttcgtgaatatatgcacttttcagacctttcattgaatagcctgtagcacggacaatgcgttgaaaatttgctttgttttcaggtttcattaactttataaatagaatacgactaattagtcttattctaacgcaattacctgtttatggaaacaattcatttaatagtgaatatgtatttatttttgcaatggaaatctaaccagtgcttgatattacatattaattgtattaaaagcagaaattcctataatttttccacattatctattttgctaacccacctaaccgcttcattccaatcttccctccaatctttcaataattcaacccaagaaacgagattattttcccactcatttccattatcactttgagctaattgcgcaatttgttgtaaatgaactaagcccacagatgccaatgcccccttgattttatgcgcttcatccgcaacacatttacgtttctgtatatcaccagtctcttgccaatcctgtaaataatcatttaaattctctaaataattaggcattaagttggcaaagagatctaatgttgataacacattctttttacccattacctcaaccaactcttgaagcattttaggatcaaaagacattttacttatcggttctgacaagactacatcgtccgaggattcctctaaaaacccttcatcaaaatatctatttaagcattcagataaagcctctaatgatagtggtttacgtaaaacatcatccattccttgttgctgatattcagctttggtttgcataatatttgctgtcaaagcaattaataaaggcagataatcaacatctccgtcctcatacctctgacgtaatttttgtgctatttctactcccgtagtatcaggcaactgaatatctaataaaattaagtcataactatttttatcaaataactcaaatgcttctgctcctgtcattgcaacatcaacattacacccaaacttatccaacatagcttttgcgacgacaatattgacttcaatatcctctaccagtaatacttttagtgcatgtgtatttattgctacttctttataatgatttgcttcatcagcttgaatgataagagtaaaaacagaaccttgatttaattcactctcaacagttaaatctccgcccattaagcgagctatacgtttcgatattgctaaaccaataccacttccctgagctttcttaccctgggaattttctgattgataaaacattgcaaaaattttacgctgctcacttttctttatgccaatccctgaatctttcaaaataaaagcataatgatcatgatctcgacgttccacttttagtgaaatctctcccccagaaggggtaaatttgacggcattattcactagattccataaaatttgactaagtctagcattatctacacagacaaaatcaggtaaattatcatcgtactgaattgtaaatttaatttttttctgctctgccattaaattagcaaaatggctgatgttactgattaattgtgagaattctacttcactacgaaataactcaatgcggcgactatcaattttttccaaatcaataatatcactgaaaatatgccctaacgatacagcactaatattaattgtttttaaatactctctttgttgtgcagataattcaccttctaataaaatacggcttaagccaatgataccatttagaggtgttcgtaactcatgactgattgtggccatcaacgttgacttatctcggctatttttttcaatcatttcttgatatcttttacgctcagtaatatctcttccaaaccccataatacagtgacattcatttactctatcatagtaaggcaccttacgaatttcaaagcaggaaagtttattgttagaatggcgaatccactgttcgtaagtaactccagtattactaattagagtatctctatctgtatctagaattaatttagcggtttctttaggataaatatcttttggagtaagatgaagtaactctttttctgaacgtcccgttaaaacttccattgccctattacatccgagaaattccccatgttgattacgataaaaaacaagatctggagaagcatcgaagaaagaacgtaaaaattcagcctgttgttctaactctacatttaaacgagcatcttgttcacgtaacaaggaaagatcattcaacgattgctccaaacgaatacgagaacgttcaagtttttctaaaattagattaaaaaaataaatcacgaaaggagccgatgttagaccaaaaataatagaacgaaaaatatcgctagtatttatgctcccagtaaatatccagctcaataggctttgtgtaaaaattgcaaacaccgctaaaataatcaaacccaataatgcggatttccctttacctaaacgtaatacccaattgacataacgctgggcatattgctttggatttttcattattacctcatcaatattcgccactactcataagaaccaatcttagttgattgattcttttaattcatcaaagaggctaaaaaatttaattgatattaaacgcttcaatataaggaagaattccttttttaagcatcttaggcacggtatgttcataatttccattaaatctaacttcaaaattaataccaaaacgattatcatagtagaaatcgtttattgtatcgcttttccccatcggagttgaaatcaaatgtctagaagtataaaaatttgcactccaacaacaagtgctataatttaaacccaattgactctcaaccagtttttttaaagcaatatcttgatagtggctcattactattgatacattattgctcaatgaccaagctataatacctccaacttgcttaatatcctgcccatagcgattatcacttaaattttgatctatatagtttttgcttgcataacgataattaagctgaatcacgttattatttttaggcttaaattgtaatgaaacatttgctaacgatgtttcgtttagacgtgtatcatattgataacttccatgccaattccagtttgaatgaaatttccagttagattctaatgaccaagaagatgagtgttttgtatcgctatttaacgactcactatcaactcttgaaggagataaatattgaatctgtcctgcactaaagttaaatacttcttttcctgttttgtcgctaaaaaatcgtgtagtaccgcctaacgtaacctgattcgcagaggcaatgcggtccaacccactataactgcgctcattaaataaagagtaataatcctgctgcaataaaacggagtcataacctaaacctaaatatttaggatttctaactccaatatttccttgatttttatatggacgatataaatattgtattgttggctcaaaaacttgtgaaaacccattaaacaaaggtctttccttttccaagacagttttaaaatccaacttaaattgaggtaatacccggagtatatgtgactctatcggtattgcttgtgcttgccccagtttctgtaaataataggtggtatatagcttagtttctaaagctaaacttcctaactggttaacaaaaggaacatttaaactaggttctaaatgaaaacgccacgctgatggcatgagtttattttgattaacaaaatgcgccatctgcccaaacatcttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgcgccatctgcccaaacatcttgaaatcaacatcagaaactaaattatttttatagtaattaagctcaatctttggtaacacatgataggtagtgctatcattttttacgtaaaatgactgaaatttttttcctgaaatagaaaaattataatctgaatgatagtaccctaatttaaactgctgtaccgcataaccatcagtactattcccgtacatagaattaaaatcagaaaagtaccgactatcactaactcttgtataatcaacagctaatctccaattattaaaaaaactcatatcatgttgccaaaatagcatataacgagatttactatgatttgcccaattttcaagtcgatccttacctaaatattcaccggctattttaccttctcctaaataagttaaataacgcagttcaggtgcaatctgccaaccacgttttgaatagtatgttggtacaaatgtcatatccatgttagaagcaatattccaatatattggctgtgcatatatataaccatctcgtcttgaatgaccaacactcggagccaataaaccagaacgacgacgatcccctattggaaattgcaaataaggagaatagaaaataggtatacccaatactttaaaacgcgcatgccataattcagcatattcctcttcaacatgctgaaccatttcattagcttcaatagcccaggagttatcatgaggtaaacaagctgtaaaagttgcatttttcattcgacgggcttgttcagctatcatgacttcatcagcaatacctcttccttgtcgaccaactaaatggtaatcgaccccgcctaactgagcatcatagttgttcaaattaatctttgcattattacctatcgcattaatgaaattatcccgataatcgaatttaccgattaaataagcaaaacgcatctgttcgttattctgttctaccttagctttttctgcaataagagaacgattaccttgcttaacactaacttcaccaaaatatgttgcctcagaaggataattcatttccatacgatctgactcaatatacacaggtagaagagtctgatcaccttgtataatatccccctgaaaagtaggaattccttgtaaacattgcattctcaaatctgctattacatattgactacagcaagctgcaacaatagcaatagaaagtaaactataacgatatggtttcataatttgattctactcacatttgtaaacaaataagcctatgtaaccgccttatttgcaaacattatcattaaatgattcttgaaaattgttgtcttttagcttgctgtcttgaataaatatcaaagcacatacagatatttctgatcaataaacgccctcgaggcgaaacaacaatccccttttcaccaatctctagcaaaccatcttttgctaacggtgctaatagtgataaatcctctgcaaagtactgattaaaatcaatctgataatcttgctcaaagcggtcatattctagcttaaaattacaaattagggctttgatcacatcacggcgtaaacagtcatctttagtcatactcaaacctttgtgtaatgcaataccacgcatttccacctcggtataatactgtttcagctctttatggttttgagcgtagctatcccccagtaaactaattgccgatacccctaagcctaacaaatccgcatcttcttgggtagtatagccttggaaattacggtgtaattccccttttgcctgagcactcgccagttcatcattaggctttgcaaagtgatccataccgataaatttataacctgcgttacctaaagtttcaatcgttttctgtaaaatttcgagcttcgtttcaggggctggcaacatttcatctttaattttgatttgtgctgcaaaacgacttggtaaatgagcatagttaaacacgctcattcgatcaggatttaactcaatcacacggtctaaggtaaacataaaactttctactgtttgtttcggtaaaccgtagatcaaatcaatattagttgaggtaaaacctagctctcttgcacgtttcattaaggaaaaaatgaactcttcatcttgctcacgattaaccagcttctgaacttctttattgaaatcttggatccccatactaattcggttaaacccaatttcacgcaaatgatcgagcatttccaactcaatctctcgcggatccatttcaatactgatttccgcatcatcgattacgttaaaatgtttgcgtaacatcgccattagacgtagcgactgttcttcatcaagataggttggcgtaccaccgccccagtggatttgagttactgttctatccttaaataaatccgcacggtatttaatctctttttctaaataatccagataaatatcgactttatgctggtggcgtgtaatgattttattacaagcacagaaataacagagtttatggcaaaatggaatatgcacataaagtgaaagtggcttattaggataacgtgcagcagcagctttaaaatcatcatcattgtaagactcgttaaactctaacgctgttgggtaagaggtatagcgaggtcctgattgattatatttttggataagattaatatcccaaatgatgtctgtcattgttattttaactcttgtttaaattgctctatgtcgcttaataattgatgaagttcctgcttaatctgctcagataactcggcctctttcgattcacgctctaggtcaagtctcattcgttcattacgttttaattccttacgagcctctaaaattggcattgattcaaccacttgatacaatgaccacattgctggatattgacttaattttttgcctagtacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagtaatggttttaatcgtaataccccttcagaaaaaccacattgctgagctaacattgctcgtccaatgacatcaatgctctcgataatcgaacgatagcgattaagttgtgcctcttttaactgttttttctgtttttttaatttaagccataaggaaattgcgtaacctgccatcgacagcacaatcaaaattgccaaaataattagaaaaaatcgcatcatcatttttaacggaaattattaatgtccatcgtttcaaattgacgcagcaaatcttctgattcgtcttcttcatcttgaatccctaactcagtcattaattcgtgaatgcgatctaaacattcatcaacaaatttctgatcttgtgcagacaatgttttacctgcttctaaatcgtctaatagctgatttaaacattcattattttctaactgttctaactcttgctctggacttaaacgaggtttctcaacttcaattggcacaggtttaataacacggtctttttctggttgattaacaaattccaccattaacggcacttttttacggctaccgatacgcggatcttttacctctttctctactttttgtttttgctcattcccttcattagtgcgagagcctgacggcaaacctttatgtttacgttttttcttttcctcacgcgcagctaaatctaattcataacgtgttggtttacggcccttagacacttttgctttaggttgtaagggtttatctgcctttcttgcaggcataatgtcggtaagacgacgacttttcttttgacgactcataatgtaattagtgaataaaaataaattcagattgtatcactaactggaaaaaatagaaaagggtgatataaatcaatccatgcctatactcaggaatttaattattttttatcatcttcatctgtgaaggttccaaggttgtcgcctctttccctaacaataaactcaccgccatcgcacttcgtgcaaaaaattcacgaatccgcactttatagtgagcatctggatattttgccgtaaaacagaccgcttcaatttggtgaaattttgcaatgaataaggctcgttcacaatgaaactgctgagaaatgatgataaagggttgtaattgaaacactttatccgcccgaataatcgaatctaacgtattataaccagcataatcctgtctaattcgctgccacggaatccccatttggcgtaaatcatgggtcatcattttgggctcattatagtaagcggtcttattatcaccgctaactaataaataattgaccttgctatgctcaaataccgctttagctgcatctaaacgatatttgtagtaaagattaggcgagcctgacggataatattttgcggttcccagaaccaacgcatattcccgttggggtaattgtcgtacatcaatataaatttgatctcgcacccaatagcctgttgcaaaatcaatagcaaacatcagcaaaaaaagaggaaagcacaatcccaatatgcctttcatcagccaaatgcttacgcgagctacccaacgtctccccgttgtttttgctgtcgattgctctgtttgagattgttctgccatcatctacttctgctgagattgtttcgcttcggcgtgtgtaatatacatcgtcgccccaataataattgctgcccctaaccatagcttacctggcggcacccagttaaagacaagccaacctgccaaaacgttcaatggcagcttaataaaatcaaaaggttgaatataagacgcatcggctaaactataggctttagccacagcaagctgtgctaacgccgtaaaaaatcccagtaaaattaagaaaccaaaatcactaaatgatggcaaactaaatccttcagggcttaaattcgtcaatgcgatcaacaagttaaatggggtaattaaaataaatagataggctaccattgtggttggcgaatcttcgctagagagctttttcaccatcaacgaataacacgcccagaaaaatgcggcagcaacaggcaataacaccacccactcaaaattttctgaccaaggttctaaaataatcatcgcccccacaaatcccaagaaggtcgcaatccagcgttttgtatccaccttctctttcaaaaacagccctgagccaatagtcacaaacagaggcgatgtcatcaacaacgcaatcccctgccaaatgggaataggataagctaaagccattgtccaacactgaataccgattgccgacaaaaacacccgaaaacagtgcataccaaaatgcttcgtcctcaacgactgaaaaaagcccatatttgccatacttggcattaaaaagacaaaagcaacaaggtattgcaccagagcaataacactggcatcaatcgttgaaacggaagttaatttaggaataagcgtattgacacaagcaaataaaaagcctgcggtaataattgcaatagcgcctttgacggggtggtgatgtgacataactacttaaaaatgaaaacaaaataagccactagcatagccgagctataataaattgcaagtttgattttcaggttacacattaccaatcgatatataacatagtaaataacgcaataatctcaacctaaagcgttatcgtctcacttcctgagcaatttgataatcgtcaaaacttcatcaacggaaatctctatattccctacgaacgacttaatcgggtcaattttctattttgtgaggaaattatatgaaacatcaatcagacagcagccatttttcggcagaacgacgttcgtttctcaaaggtggtgctgcgttaagtggggcggcacttgcagcaagtgctgttcaaattccaattgcaaaagctaatccaaaaccaaccgcttctacagcgaatgaaaaacttgtttggagtgcttgtaccgtaaactgccacagccgttgcccgttgcgtatgcacgttcaagatggagtgattaaatatgtagaaactgataatcttggtttagacaattacggcgatttccaccaagtgcgtgcttaccgcttgttagctttgtttcatctattgaacacaaactaccaacagcgtggcaaccgttagggcgtgtagtggttgctatttcaggtttaatttttatcggggcaatggcaaaactctacctaatcccaactgtgccaacgtggaatagcgtctatacgccagtatcgtttttcttaacggttgtattagctggttctgctttggcagtcggcttattacaagcggtacgttgcggtgagtatttacaaaaaaccttggttggtattgcaatcgttggggcgattgccactgcaattagcacctacttgaactatcaatatctcttaggggtaaaaacggcgatattcactgcattagatctcgtacctgattatctcactatcacctttatccactttggattgattattgtcggtattgtcttattgctagtagcactgaaaaaacgcactacactcatcagcttcagcggatttgcgttaatcctgatcggcgaattactcggtagaaccttgttttacggattacatatgacggtaggattgaaagcgttagggggctaacttatatagcatttctttcacttcccttccctcttacgagggaaggtggaatatcataacctgataacatgtcaaagatacttgaattaaacaagaaaaatttgacagaagcaaaggcaaagtgagatggtggtaagaacgctccaaattactttgtcatcgtcccgaccaaaaaagtagattacttcttccaccccttcaacgcatctgcaaaagcattgttgccaaaactttgacgttcaggcttttgcgagcggtcggatttgccaaactctttgcgtttctcaccgcttgtatcacgtttatccgttggcttatcgtccaaacgcatcgttaaggcaatacgtttacgagccacatccacttctaacaccttcactttaaccacatcacctgttttcaccacttggtgcggatcttcaacaaagctgttcgacaacattgaaatatgcactaaaccgtcttgatgaacgccaatatccacaaacgccccgaagttcgttacgttagtgacagtgccttctaaaatcataccgactttcaaatcgctgatttcttctacgccgtccataaaaattgccgttttgaactcaccacgagggtcacgccctggcttttcaagctctttgaaaatatcgtttaccgttggcaaaccaaactgttcatcgacaaaatctttggcattcaaactatgaattttcgttgaattacccatcaactcacctaacgtagaagcggttgcttgcaagattttttccaccacaggataggcttctgggtgaacacttgaggcatcaagcggattttttccgcctaaaattcgcataaaaccagcacactgctcaaaggcttttggtcctaagcgagcgacttttttcaggtcagaacgagaattaaaacgcccattttcatcacggtaagccacaatattttgagctaaggttttcgtcatacctgccacacgcgcaagcaatggtgcagaagcggtatttaagtccacgcccaccgcatttacgcaatcttcgaccaccgcatccagtttacgtgccagttgcgactgattaacatcgtgctgatactgccctacaccaatcgctttaggttcaattttcaccaattccgccaacggatcttgcaaacggcgagcaatcgacaccgcaccacgcaaggatacatcaagctcagggaactctgttgcggccaattctgaagccgaataaacagatgctccagcttcactcaccaccacagtttgcggtttattctctttgatctctttaatcacttctttggcaaagcgttccgtttcacgggaagccgtgccgttaccaatcgcaattaaatccacattatgctgtttaatcagcttataaatggtcaccattgcaacgtccatctgtcccgtatgaggataaatcgtggcggtatccaataatttacccgtattatcgaccacagccactttcactccagtacgcaaacctgggtctaatcccatcgtatttcttgcccctgcaggtgcagccattaataatgcggataaattacgcgcaaacacatcaattgcttcttcttccgctttttctcgcaatgcccccattaattccgtttcaaggtgtaacaacgctttgattttccacgtccatgcaatcacctgtgaacgccaactgtctgccggttgctgacgaagttgtacgcctaaatgctcacgaataatctcttcacaataacttgaacggctaccttcttccgcatcaggatcggcattcaaattgagcgacaaaataccctcattacgcccacggaacatcgctaaggcacgatgtgacggcacatttttcaacggctcactgtgagcaaaatagtcacggaatttctcgccttcttcttccttaccgtcaatcaccttggcttcaagggtggcattagcgatcagatattgacgtaattttgcaagcagatctgcatcttcggaaaaacgttccatcaaaatatatcttgccccatcaagtgcagatttcacatctgccacacctttttctgcgtccacataggcttcagcgactgtttcaggcacttggctaggatcgttccaaagactatccgccaacggctcaagccctgcttcaatcgcaatttgcccacgagtacggcgttttggtttatacggcaaatagagatcttcaagctccgttttactctgcgtttgttcaattttctcacgcagttcatcggtgagcttgccttgctcttcaatggatttcaaaatagtttgacggcggtcgtttagctcacgcaaatagagtaaacgagtttcaaaatgacgaagttgagtatcgtccaatccgcctgtgacttctttacgataacgagcgataaacggaatggtatttccttcatcaagtaaagtcatcgctgcaaaaatttgttcagatcgcaccgctaactctgcggcaataatttggctgatttggtggttgagttctgtcattgggtatcctgtaaaaacacattaaatttacaaggcatattttagcagggaaatgggaaaatttctgagaaaaaagaggttacatattagtataaaacctctcattccgagaggttttattgcgctctaattatcttttcttcgcttttggatttggaaggtctgtgatagagccttcaaatacctctgctgcaagacctacagactcgtgtagagttgggtgagcgtggatagttaatgcaatatcttctgcatcacagcccatttcaatcgctaaaccgatttcacctaacaattcaccgccgttagtacccacaattgcaccaccaagtaaacgatgtgtatctttatcgaagattagttttgtcataccgtctgcacattcagacgcaatcgcacgacctgaagcagcccaagggaacttcgccacttcgtagtttaagccttcttgtttacactctttctcagttttacctacccaagctacttctggctcagtataagcaatagatgggatcacttttggatcgaagtaatgtttttgtcctgcaattacttctgcagcaacgtgaccttcgtgaacacctttgtgtgctaacattggctgacccacgatgtcaccgatagcgaagatgtgtggcacgttagttcgcatttgtttatctaccgcgataaagccacgatcatcaacattcacacctgctttacctgcatctaatagtttgccgttcggtacacgaccgatagctactaatactgcatcatagcgtttagtatcgttgcacgctttgccttccattgaaacatagataccgtcgtcttttgcttcaactgcagtcactttagtttcaagcattaatttgaatttcttctcaatgcgtttggtgaaaattgctacaacgtctttatccgctgctggaataacttggtcgaacatttcaaccacttccacttctgaacctaaggcttgatataccgtacccatttctaaaccgatgataccaccacccataatgagtaattttttcggaatttcttttaatttaagtgcgtctgttgagtcccaaatacgcggatcgtggtgtgggataaatggtaattgaattgggcgagaacctgctgcaataatcgcattgtcgaatttaatggttgttgggtgtccatcacggtcacgagcaactagcgtatgtggatcagcaaaggttgcctgaccttcaacaacagtcactttacgcgcttttgccatacctgctaaaccgccagtcagttttgcaactaccgcttctttacctgcacgcactttgtctaaatcaatagttggttcgccaaatgtaataccattatgctctgcgcgttttgcttcttcaatgatttttgcaacgtgtaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataatgctttagacggaatacaacctacgtttaagcacacaccaccaagggttgaataacgttcaactaagactgtttctaaacctaaatcggcacaacggaaagccgcagaataacctgctggacctgcaccgagtaccactacttgtgttttaatttcttggctcataaaatttttcctcttatgtagggacacactgcgtgtgtccgcggacgcaagcattgcgtccctacaataagcggtcttttttgcagaaaattttgcaaatctgaccgcttatatcaattacattactaaacgacgaatgtccgcaagtacaccgttaatgtagcttaagaaacgagcaccatccgcaccgtcaattacacggtggtcgaaagataatgataacggaagcattaagcgtggctcaaactctttaccgttccattgtggcatcatttctgatttcgatacgcctaaaattgcaacttcaggggcattcactattggtgtgaagtgggttgtaccgataccgcctaagcttgaaatggtgaaacaaccgccttgcatatctgcggcagttaatttaccttcacgcgctttcttagacacttccattaattcacgagaaagctcaacaatgcctttctcgttcacatttttaaatactggaacaactaagccgtttggtgtatctactgcaacgccgatattaatatatttcttaagggtaagtttttgaccgtcttcagaaattgagctgttgaaacgtgggtacgcttctaacgctttcgctaccgctttcataatgaacaccactggcgtgattttcacatctaatttttgtttttcagccagtttgttttgttctttacggaaattctctaaatcggtgatgtccgtacgatcaaagtgtgtaacgtgtggaatcatcacccagttacgatgtaagttcgcacctgagatcttattgatacggcttaattcaacttcttcaatttcaccaaatttgctgaaatcgactttcggccacggtaataagcctaaacctgcaccgttcgctacgccattgcctgctgctggagctttacctgatttcacatcttcaaatacttgaaccgcagttttcacataagcttgaatatcttctttaacgatacgacctttgcgacctgtacctttgatacgatctaagtttacaccaaactcacgcgctaagcgacgaatcactggggttgcgtgggcataaactgcacttgcaaccacttgttcttggcttaaaccagatacattacctgattgtgctggcgccactgcaactggtgcaggcgctgccgccgcttgtggggctggagcagatgccgccgctggcgctgcacctgcgacttcaaatttcataattaatgagccagttgaaactttatcgccgactttcactaaaatttcttttaccacacctgcgattggtgctggcacttccatagaggctttgtcgccttctacgttgataatagattgatcaacagcaacggtatcacctactttaaccataatttcagttacgttgacttcatcgccaccgatatctggtacattgacatcaacaactgcactcgctgtcggtgctgccgctggagctggtgcaacttctgcgaccgcttgtggtgctggtgctgaacctgctgcttctaaaactaacattggtgaacctgtggtcactttatcgcccactttcactaaaacttcttttaccacacctgcttctggtgctggtacttccatagaggctttgtcaccttctacattgataatagattggtcagcagcaatagtatcgcccactttgaccatcacttcggttacggtaacttcatcaccaccgatatctggaatttgaatttgttttgacatttttgtttttccttaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggggggattttatgcgtataacggattaatacgatctacatttaagccaaatttcgcaatggcatcagcaaccactttggtttctactgtgccttctttcgctaattgacttaatgcagcaacaacaacataacgtgcatctacttcgaagtgttcgcgtaagtttgcacggctgtctgaacgaccgaaaccgtctgtacctaaaacatggtagtgcttgcttggcacatacgcacggatttgttctgcgtaaagtttcatatagtcagttgaagcgactgttggtaaatctgctaacacttgtgaaacataaggtacgcgtggggtttctgttgggtgtaataagttccaacgagccgcatccgcaccgtcacgacctaattcgttgaatgaaggtgctgagaagacatctgcagtgacaccatattcattagcaaggatttgtgccgcttcacgtacatggcgcatgattgcacctgaacttaacaattgaacgtgacctttgcctttaccttctactgtttcaaacttatataaacctttacggataccttcttccgcacctgcaggcattgctggttgttcggtaatttcatttaatgtcgtgaggtaatagaacacatcttcttgtttttcaccgtacatacggttgataccgtcttgaacgataacagccacttcaaaggcaaatgctggatcgtaagtgatacagttcgggataacgcctgcttggatatggctatgaccatcttcgtgttgtaaaccttcaccgtttaaagttgtacggcctgatgtaccaccgatcataaagccacgcgctaattggtcacctgctaaccacatcatatcgccaacacgttggaagccgaacatggagtagtagatgaagaatgggatcatcggctggttgttcacggagtatgaagttgctgctgcaacccaagatgccgttgcacctaactcgttgataccttcttgtaacacttgaccgtctgttgcttcacggtagtaagcgactaaatcacggtctgatggcacatagttttgaccatgtgggttataaataccgatttgacggaataaaccttccataccaaaggtacgagcttcgtccgcaatgataggaacgatggtttgaccgatatttttatcttttaataagatatttaatacacgagagaatgccattgtggttgaaatgtcacgtggttgtgcatctaataatgcttggaattctgataatgcaggaactttgtactctacggtaaatttcggtttacgtgctggtaaataaccatttaactctttacgacgaccgtgtaagtagttgtactcttctgaaccttctgggaaagttacatattctaagttttctacttgttcgtccgttaatggcaaatggaagtagtcacggaagccttttaagctatctaatgacatttttttcgattggtgagcagtgtttttactttctgcttcagggattttatagccttttacttggtgagctaagataaccactggtttatttgaacgtttcgcacgctcaaatgcggcatacattttctctgaatcgtgcgcaccacgacgtaagtgccaaatttcttcatctgtcatatccgcaactaatgcagcagtttctggataacgaccgaagaagtgttcacgtacataagcaccatcttttgatttgaaggttaagtagtcaccatcaaccacttccatcattaattgtgctaatttgcctgaggtatctttagcgaataatttatcccagttgctgccccataagactttgatgacttcccagccggtacctgtaaataaaccttctaattcttgaacgattttaccgttaccatttactggaccgtctaaacgttgaaggttacagctaataacgaaaatcaagttatctaatttttcacgacctgcaacggttaatgcacctttagattcgatttcatccatttcaccgtcacctaagaaggcataaacggtttgacctgatgtatctttaataccacgattttgtaaatattttaagaaacgtgcttgataaatcgcattaactggacctaaacccatagatacggtagagaattgccagtattcaggcattaatttcgggtgtgggtatgaagataaaccatcagcaaaagcttcttgacggaaattatctaattgctctgcggttaagcgaccttctaagaaagaacgtgcatagatacctggtgcggcatgaccttgagaataaactaagtcaccgccgtctttatctgtggctgctttgaagaaatggttaaaacaaacttcatacatggttgcagcagattggaaagttgaaatgtgaccaccaagatccaaatctttcttctggctacgtaataccattgcaatcgcattccagcgaactgctgaacgaatacgacgctcaatttcttgatttcctggataaacaggctgttcagacactggaatggtgtttacataatcagttgttacgcctgatggaagccctacaccctgagtgcgagcatgttgcattacttgttgaataataaattgagcacgctcagtgccctcttctttaactaaagagtttactgagtctaaccattcttgcgtttcgaatggatctacgtcatgtgctaacatttctgacatagtcttttccttttttttctctgatgaataaaacattgcaaaattgttacaattttgccaaccgttgaaactttaaccaaaagtccgttatttatttttgttttagatcaataaaacacggcaaatagccctactgatattcgtagagctgcttttaggaaagcgtctatcgccttgattttcaacgacttttttttgatttatcaaaaattgttgaaaatttatagacaaatttgacctcaagatagcaaaaaccacttattttgtctatttttcaaagcctaaaatgttagctccatcacagattatttctttaggcaaacgtttgctttttgtgatacactcctcaccgcttgtattacactcaatccaaaggtacaaaatgacaaccaacatcgaaatcgccattgtaatgggttcaaaaagcgattgggcaactatgtccgaagcaacccaaattctcgatcaatttaacattccttatcacgttgaagtagtttcagctcatcgtacgcccgataaactgtttgaatttgccgaaaccgcagaacaaaaaggttacaaagtgattattgcaggagctggcggggcggctcatctacctggtatgattgcagcgaaaaccattgttcctgtcttgggtgtacctgtaaaaagctcaatgctcagtggcgtggatagtctttactctatcgttcaaatgccaaaaggcattcctgtcggcactcttgctattggtccagctggggctgcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaggattattagcggcacaaattttaggtgcatttaaccctgaaattgcactaaaattacgatctttccgcaatgaacaaagacaatctgtgttagacaatccagacccacgaatttaaatgagtaaaaaattattaattctccacacaggtggaactatttcaatgagcgaaggcgaagatggcaaagtatcgccttcagctcaaaacccacttttaacggcgttagctaaactcaatcaccctgctcaactttatcaagaagcgattttacacgttccttcgccccatattaccttggcacattggcagttgctaaaagatcggatcgaacaggcagtgttagccgaaggttatgatggcatcgtgattacacacggcacagacaccttagaagaaacagcctatttccttgatttagccttgaaagtgaatgttcccgttgccattacaggggcaatgcgttctagcaatgaattaggctctgacggtttaattaacctacaaagtgccattttggtggcattaagtgatgaaagccaaaacaaaggtgttttggtggttatgaatgatgaaattcataatgccaaatttgtgaccaaaacccatactactaacgtagcaaccttccaaacgcccacatttgggccttgtggtttggttaccaaaaaccgtgcaatttatttccaacatctgaccgcttacgaacgctttccgattgatcgtttggaaaaatcaaacattcaactggtcaaagcctatgtcggtatggatagcttcttactagaacaactggctcaaagccgttgtgacggcgtagtggttgaagctttaggggcaggaaacctaccgccatcttgtctagcagggatttccgccctattaaatgcaaatatcccagtggtattggtgtcccgtgcctttaacggtattacgcaagatgtgtatgattatcttggtggcggtaagcaactgaaacaacaaggggtcattttcacccaaggattaagcggacagaaagctcgcattaagttgatggttttgttgaatcaaacgttggaaaaaccgttggcggaatatttttaaataattaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtgtgtccgtatttctattgggtactcaatacaatatttgtcacggacacacgcagtgtgtccctactattaaggataactatgcaaaaaagcacactctacccccctatttatgttcttggtaacggacaacttggcagaatgttacgttatgcaggtatgccattagacattgaagtccagccattagcctttgacgatcccgtattcgatctcgcagaaaacagtttgattaccgctgaaattgaacgctgggcagaaacgcctttaacaaatttattaagcaaccataaaaactttgtcaatctttccgttttcggacaacttgccgaccgttttacccaaaaatcattgctcgatcagcttaatctctctacatcgccttggcagttattaagttctcctgagcaatggcagcaagtctttgaaaacattggtgaaaaaatggtagtgaaacgtcgtacagggggctatgacggtcgtgggcagtggattgtcactaaagataatgtcgaacaaattacctctgatttatttggtgacgtaattgcagaaaaatttattccctttgatggcgaagtttccttagtgggtgcaaggttccgtaatggcgaaactcacttctaccctgtaacccataacttacaacaaaacggcattttgcgttacagcgttgcggatatcacgctaccccatcaacaaatattccaacaacaagcagaacaaatgctatctgcgattatgcacgaactcaattatgttggtgtaatggcaatggaatgttttgtagtaggcgaaaaactgctgataaatgaactcgctccacgcgtacacaatagtggacattggacgcagttaggctgttcaatcagtcaatttgaattgcatttgcgtgcattacttgatttaccaaccccagagcttaaacctattgcaccaagtgtaatggtgaaccttattgggatcgaacatcataatgaatggttagatattccatttagccaactgcattggtatggaaaagaagttcgagcaggcagaaaattggggcatattaacctttgccaccctgataaaaccgttatcattgaaaacttgcaaaaactcaaaccttatctctctgaggatttttattcggggttggattgggtaaaaaatatcatcgaacatacgtaatttcgttagccattaagaaagtttttgtaatttcgtcaaaacttataataatatactgtgtttctacttacatttcatatttaaggaataaaaatggttatattacatactaatcttggtgatatcaaaattatgctaaattttgagaaagcacctattacttctgcaaattttgagtcttattgtaaagaaggtttttacaataatactattttccaccgtgttattgataatttcatgattcaaggtggaggtatggaagtaggaatgatagaaaaaccaaccagagaaccaattaaaaatgaagcaagtaacggtttaagtaataaacggggtagtattgcgatggctcgtacagcagatcctcattcagccacctcacaatttttcattaatgttgtagataatgctttcttagactaccgaacaaaagaactatttggcaaaactgtagttcaagaatgggggtatgctgtttttggagaagttgtagatggtatggatattgtagataaaataaaagttatctctacacataattatggatggcatactgatgtccctaaacatgatatagtcattacttctgtaagtattgaataaatcacaatgtcctctattcctctctcaatctaattattttctactttaaaataatcgtgagtaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcaatggctggtttaggagctattgtcactggcattgatatggcagcagatgctctactagttgctagacaacatgcagaatctaatcacttaaatatttgctatcggcaaattactgtagaagactttctaaaacaacattgtataacggatactgaaaaatttgatattattacctgtatggaggtgcttgaacatgtacccaatcctcattctattattcagagttgtaagaatttattaaaggaagatggtttactctttatttcaaccattaatagaacagcgaaagcatacatgttgattattataggcgcagaatatgttctcaaaatgcttcctaaaggcactcacaatttcgaaaaatttattaaaccctcggagttgctaagatggtgctctcaagaagattttgaatgtaaagaaatcgtcggataccattttaatcctttaacaaagaatttttggatcaataaggatataaattgtaattatattgccgtactacaaaatagctaaaactagctacagtaatggcaaaaagagaaatgataaagtattaagtcaatagcataaaaggcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcaactgtttcacattaacagcgtccgtatctgctaccccttcagcgacattacctaataccatcggagtttcatttgccaaattcacttttactgctaatgacttaagcgtaatactgccatctggattttgcgttttggttgagaatttacctttaacattcaccactggaattaacttaatcgaaccatctttagcaggttcttccaaatagaaattaccgcccatattgataattgatttgccgtcttccgttgcatactctatcggtaaaccgctgacactcacatttcctcgctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgatattaccttccttactaaaagtactgctaccaacagaaaccgcaccaatatcattacctcctgtagatttaaagccattctcaacagtgcttccctctgtcacagaaaaagtttgttttgctccttcaataccccctttcgtatctgctctagataaataacccaatgcaataccaccgtcaacgctaacagatgatttgttacccaatgcagtggctctgagtttatttgcattagccccttgaccgactgcaacagagcctattcctcgtgcttgtgctccataaccataagccactgcattattgtctgcttttgcagttgccccaacggctacggaatagttatagaatgtttgagctgaataacctatcgcaatagaagtcctaccttcagcttctgcgttctgaccgatgacaatagaaccaggcccaaccctactattttgaccaataccaatagtaccaccgtcagctgattcacgccctccggctccagaaccatcttcataccatgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccactttttaccaacacttttgtctactatgtcgcataccaaatgcttaaaaagtgattgaagtagactaatcccagtataatctacttcaatattttcattatcttagtgcactcttcaatgcttctgctttatccgttttttcccaagggaaatgctcacgaccgaagtgtccgtaagcggcagtttcacgataaatcggacggattaaatctaacattttgattaagccgtatggacgtaaatcgaaatgttcacgcactaaacgcactaacacttcattactcactttaccagtaccgaaggtttccaccataattgatgtcggctctgcaataccaatagcataagaaagctgaatttcacaacgatctgctaaacctgctgcgacaatatttttcgcaacataacgtgcagcgtaagcagctgatctatccacttttgacggatctttacccgagaaagccccgccaccgtgacgagctgcaccgccgtaggtatcaacgataattttacgacccgttaaaccacagtcgcccattggaccgccgatcacgaaacgacctgtcgggttgataaagtatttggtgttttggcttaaccattcgcttggcaatattggcttgatgatctcttccatcacaccttcaaacacggttttctgatcaacgtgttctgcgtgttgggttgaaagcaccacagtatcaatgcctttaattttgttatcttcgtaaataaaggttaattggcttttcgcatctgggcgtaaccaatctaatttgcctgacttacgcactttcgcttgttgttccattaagcggtgagcgtaagtgactggagctggcattaacacttccgtttcatttgtcgcataaccgaacataatcccttggtcgcctgcaccttgctctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggttagcacgatctacaccttgattgatgtctggcgattgtttaccgatagcatttaataccgcacaagagtgtgcatcaaagcccatatctgaatgggtataaccgatgtcgcaaatcacttggcgagttaagttttcaatatccacccaagcagaagtggtgatttcaccgcccacgagagccatacctgtttttacataggtttcacacgctacacgtgctttcgggtcttgtttgaggatttcatctaatactgcatctgaaatttggtctgcgattttatctgggtgaccttcagataccgattctgatgtaaatagattgatagccataattattccttgtagggtacgcaactaacgcaccatgattgttatttggtgcattaacgcaccctaagaaattcaacaagcagtaagatattgcaaaaaaatacgacaatgcttaccgcttgtaagaaatttgttttagaagtttttccgtctagatggctataatacgttgtttaagtaataatgacaaatatttttttgaatatttatgctttctaaacatagaaataattctctagctcttagaagaaaaaaggaggaggatcatttatgaaaatctcttaagaaacataggaacaatagtatatttattgcttttttcaaaaatcaccttagaatgtctgagttatttatttctacaggagtataaaaatgggtacactaggctatgcattattaacagtcgttggtgcattgggcataatcgtgatgtttgcaatcaacattttctaatgttgcattttatgaaatggtgagttgggtgactggctcaccatttttatttatgggataagctatgtcaaaaattacctttgcttctttaaattttaatcaatcaaatacccctgtttcagcacagtttgatgatatttatttttctacgcaagatgggctggcggagagccattatgtctttcaagagggtaatcaactttgggaaaaatggcaacgacacacccgatctttctttgtgattgccgaaacaggctttgggacagggttgaatttttttgctgtggcagaaaagtttaaggcatttttagcggaatatccgacttcaccacttaaacggctctattttatctcttttgaaaaatttccgataaaagccgaacaattacagcaaattcaccaacattatccgcaatttgcagatttttccacgaaacttatcgcttgttggcaacctagacaggttgggtgtcagcgttaccattttgaacaaatttaccttgatatttggtttggcaacctattagagaatttgccacaactgggcgactattataacaatctgatcgattgctggtttttagatggcttttcgcccgacaaaaatcctgaaatgtggaacgaaagcctttatcagcaaatgttccgcctaacacaagcgggcggatcttttgcgacttttaccgcatcaagcaatgtccgccgtggattgcaagcggtcggttttgaggtgaaaaaacgtaaaggtttcggcaaaaaacgtgaaatgctgtggggcgagaagcctgacaatcaaacggaaaaccacattcgctttccttatttttatcaatctaaccaaacagagagcgatgatgtggcgattgtcggtggcggtattgcaagccttgctgttgccttgtctttgctagaacggggcaaacaggtcacactttattgtaaagatgaacagttagcaaaaaatgcgtctggcaatttacagggggcgatttacccacaactcagcgacgatgatgagcgaaatgtgcgtttttatgtgcatagcttcgattatgcgttgcaacgttttaagcagttggctcaagcggtcacatttgaacacgatttttcaggggtggcattgtatgcttataacgataaaaccgcacacaaactgcaaaaaatggcggagcaaggttgggatagcgaactttatcaactctgctcagctcaagatttgagtgaaaaaataggcttaacggtacaaaatggtggtgcttttattgctcagggcggttggctttcacctgtgcagtttgtgcaaaatgcctttgctttattgcaacaacgaggcttgaaggtggtgttaaatcatcaggtggaaaatcctgtgtggcttgcaggaaaatggcaatggcaacatcaagggcaaacctttgcccatcaaaccttagtgttggcaaacgggcatttattaaccgattttgctcagagccacggtattcccctttatcctgtgcgtgggcaagtcagccaaatcccaacgacagaagccttgtcgaagttaaaatgtgtggtttgttatgatggctatttaacgccgagctcagctcaacagacccattgtatcggggcaagccatttaagagacaatgccgatgaacagttcagtttagtggaacacgagcaaaacattgcaaaacttcagcagaatttgaccgcttgtgaatggacgcaacagcttgatttttctggaaatcttgccaaagtcggcattcgtgcggcatttcgagatcgtgtgccgatggtgggggctgtgccagattttgaagcacaaaaaacgcaatatgctaacttgtataatcaatttcgccgtcgagagccgattgaaactgccaactgctatccaaatctctatttagtcgcagggcttggctcacgaggtttaaccaccgcctttttattgggcgaattattagcgagccaaatttgtggcgaaccgcttccccttagccaagatattttgcaagggttaagcacaaatcgaacctggatacggaatttgttgaggggaagagagataacataaagggctaaatatataggcatagtagacaaaatagttgctatgcccccaatgaaaacaactttatttgttcagacccctatcaaaagtgcttttgggtttcaagagaaagtaactttatggggcttatcaggcgggattatcaatatcaataaattcgacctctaatccatactcttttgccagccattcacctaaggctttcacgccatctctttcggttgcgtggtgtccgcaagcaaaatagtaaatgccttgttctcgtgccgaatgggtcgtttgctctgaaatctcaccgctaataaaggcatcgatctgtttatttgcggctaaatcaatataaccttgtccaccgccggtacagatagccacggtcttaattaatttttgtggaaaatctgcaataaattcgtcacataaaatcggtttacgcttaagagctttttctagtctgttcgctaactcttgtgctgaaatggcttcatctaattcgccatatactggaatggaaagggctttctcttccaaaccttgtaagttttttaccccaatatgttttgcaagttgagcgttgttgcctaattccgcgtgcatatcaaggggaagatgatagccaaatagattgatgtcgttgactagcagttgtttgatccgctttcctttcataccacgaatacaagggttttcgcttttccaaaaatagccgtgatgaacaaggattgcatcggctcttttcgcaatagcctgttcaattaagggtaaactagcggtgacacctgtgataattttgcgaatttcacgacgaccttcgacctgtaagccatttggagcataatctgcaatggctttactgttgagtttttcatcaagaatttgttcaagttgtagattaatgagcattgtcactcctctagggtgatcttttatctaggatatagatgcatacgctatatatttagcgaaataatttattgcttaaaagtcaatacgttataagtaattataaatttagatatggaggcgtgtaccggagtcgaaccgatctacatggatttgcaatccagtgcataaccgctttgctaacacgccctaagaaaatatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgaattgttcttggaaacggtgtgcattctacctatttctaaataagtgtcaaatatttattttataaaacaaaattaattgatgaaaaaaagggcattgattgtgtttatctcaataaatggttaaacggctgaatagtcacttgctcacctacggcaacattgccacgttcttgctcaagcacaataaaacagttgctttcattaaacgcactaaaaatatgtgagccttgtgtaccgatggttttaacttcaagttgtccattttcattcgcatagaaaaagccccgttggaaatcttggcggccagcagctttcttaagtgtaacagcggtacaagcggtcagatttggtgaaaagtttgcaatatgttcatcggatctgcccgctagtttcaataatgcaggctgaacaagttgatagaaagtgactaaagcagacacaggattacccggtaaaccaaagaaccacgctttttccaatttaccaaatgcaaaaggtttacccggtttcatcgcaattttccaaaagccgatttgccccagtttttccaagacatctttagtgaaatccgcctcgccaacggacacaccaccacttgtgattaacacatcggtgttttgttgtacttcggtgaaggtcttctcaaacagactaggatcatcaggcaaaataccgtaatcgacaatttcacaatccattttttctagcaaaagacgaacggtaaaacggtttgtatcgtaaatctgtccttcttgtaacggatttccaacagacactaattcatcacctgttgaaagaatagcgactttcaaacgtggataaacagcaactttatcaatccctagtgaagccaatagtggtaggcttgctacatttaataggctacctttagcgagaaccaattccccttgcttcacatcttcaccaatacgacggatattatcccccaatttcttcggtaagcgattaatggtgacagtaccatcggcattcagcgtcgtatcttcctgcatcactacggcatcagcttccactggcacttttgcccccgtcataattcgtacacagcttccttgtggcatttcagctagaaacggattacctgcaaaggctttacctgcgatttgtagcgtagtggaatgttctagatctgccattcgtaccgcatagccgtccattgcagagttatcaaaattcggcacgttaatcggtgagaaaatatcctcggcacaaattcggtttaccgcttgatcaagcggaataatctcttgtgatgttggacgtggtagttggtttagcatcgtatcgagtgcttgagaaagtggaagtaaagacattgggtgttccttaatataagtagtagggacacactgcgtgtgtccgccaaattgtgaggggcagtcttttttaaatggacacactcagtgtgtccctacatctatttatgacataattttgttgtaagtaatacatcaccccatctgcgcctgtgtaataaaatctttcaacccgagcaaaatattattaatagcaaccgcagaaagaattaaacccattacacgactaataatcgccgcccctgcgtgtccgataaaatgttgaatacggtttgccactaaaaagagaatataggtaattaacagtacagataacataatccccgtggtaatcacctgatcaccaaaactataacgatgattatccgtcaataacaccaccgccatcattgcacctggtgaggcaattgacggcacagccaagggataaaccgctaattcatgtaaattactacgcatttttatttcttgatccggtttactttcaccaaagatcatcgttaaggcgaaaagcaacaaaaccaatcctccggcaatttgaaatgccgataaagggatctgcatcgcatcaagtagccattgtcctaacaccaagaaaaagagtaaaatcccagccgcaattaaaatcgcattacgggcaatcttacggcgatcttctggtgataaaccaacggtttttgccaaataaactggaatggagcctattgggtcgatgaccgcccaaagaacaacgaattggacaactaacgaatcaaacatttacttttccttataaaacaaaatcttcgttattgtgcaataaatttaccttaaaaccaaacaacttatttaattttcaatgattttttttacagatttaaccttaaaacgtggtcaaaccatcttacttgaacaagcaaatgcgaccattcatacagggcaaaaagtcggcttaatcggcaaaaacggctgtggtaaatcgtcactgtttgccttattaaaaaatgaactacaagcagagggcggtgatgccagctatccgaaaaactggtctattgcgtgggtaaatcaagaaacacccgcattagatatctctgcattggattatgtaatccaaggcgatcgagaatatacccaactcaccgctcaacttgagcaagccaaccttgagaataacggcaatttgattgccaccttacacgcccaactggataccattgacgcttggaccattcaatctagagccgcaaccctactcaatggtttaagttttagcaccgaacagcttcaactgccggtaaaatccttttcgggcggttggcgaatgcggttaaatttggctcaagctttaatttgtcgttccgatttgttgctacttgacgagccaaccaaccacttagatttagatgctgtgatctggcttgaacgctggttaagcaactatcgtggcaccttattgctcatttcccacgaccgagattttctcgatccgattatcgaccgtgtcttgcatattgaacagcaaaaactgtttgattacacgggcaattacagttcgtttgaaatccaacgagcaacgaaactcgctcaacaaaatgcagcttaccagcaacagcagcaaaaaatcacccatttgcagaaatttatcgaccgctttaaagccaaagccaccaaagcaaaacaggctcaaagccgtgtcaaagcccttgaaaaaatggaactgattgccccagcttatgcggatagtccattttcctttgaatttagagagccactttcactgcctaaccctttattaatgatggaaaaagtcagtgcaggctatggcgagagaaccgtattgcaatcagtcaaactcaacctagtacctggttctcgcattggtttattagggcgaaacggtgcagggaaatccaccttgattaagctactggcaggggaaattcaagcacaatcagggcatacgcaactggcaaaaggcgttcaacttggctatttcgctcaacatcaattagacaccttaagagcagatgaaagtgccttgtggcatttagctcgccttgcccctgaaaaaaccgaacaggaactacgcaactatttgggcggttttgcgtttcacggcgataaagtcaaacaagcggtcagttctttctctggcggtgaaaaagctcgccttgtgcttgcgcttatcgtatggcaacgcccgaacttactgctactcgacgaaccgaccaaccacctagatctcgatatgcgtcaagccttaacagaagcgctgacacaatatgaaggatcgttggtgatcgtctcccacgaccgtcatttattacgcagtaccgtcaatgaattttacttagttcacgacggcaaagtggaagaatttaacggcgatttagaagactatcaaaaatggctaaatgagctaaatgctcagttggaatttgcaaaaaaagcagacaatccgaccgcttgtcacaatgaaaacagtgcggtaaaccgcaaagagcaaaaacgccaagaagccgaattacgccaacaagccgccccactgcgtaaaaagctgacgcagttggaaaaagagttagagaagctcaccgctagtttaacaaccctagaagaaacgctggcttcccccgaaatttacgacgtggaaaataaagccaaattgacagacactttggcaaagcgagtggcaaccaaaaaacagttggaagaagttgaaatggaatggctggaagttcaagagcagttggaagtattgatgaacggataatttaaaatattagcatagtagacaaaagtgctggttttaattatttcctttaattatcaccaacattttggtctattatgccaaatgttttcgtagcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacaagctgacgacggcgaaccacaagggcttttttaaggggcttagtttttactgaaccagcaactattttgtctactatgccgaaagataatacaatttgagaataataaaggcagaagataccctctgcctttattagaaaactacagtttgcctgctgcttctcggcttgcaactgcatcgcctaaatcctgattatccacagatttttcttcaggtttatcatcttgaaccgttgatgctttatcttcatcatcgttccccgaattactccagcctgatggttcaccaacaggtctgcggttcattaaatcatcaatttgcttgcgatcaagcgtttcgtacttcaataaagcatctttcattgcgtgcaagatgtcgatgttatctaacaatgtctgcttcgctcgctcatagttacgatcaatgattttacgcatctcttggtcaatcaaattttgcgacgcttcggaaacccctttaattgctcccattccatcttcattttgatagaacaatggtcctagctcttttgaaaagccccattgcgttaccatcgctctcgcaatttgtgtcgcacggtgaatatctgatgaagcccctgtggtaattttatcttcaccaaaaataataccctcagcgatacgccctgcaaataaggtagaaagttggctttctaatttaggaaaggtttcactaacacgatctccctcaggtaaaaactgtgcaaaacctaatgcttgcccacgaggtacaatggtcactttattcagtggatcgtgttctggcattaaataacctacaatcacgtgtcccgcttcgtgataagccgtattgataatctctttttccgtcattgtatttgaacgacgttctggccccatattgattttatctcgagctttctcaaaatcgtccattgttacaacacgtttattttgacgagctgcaaataacgcagcttcattcacaaggttagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacaaggttagcaagctgagcgcctgaataaccaggggtaccacgagcaacaaccatcggatctacatctgctgcaagcggtacttttttcatatgaactttcaaaatctgctcacgtcctttcacattcgggagatctaccgtcacttggcggtcaaaacgacctggacgagttaaagcgttatcaagcacatctgcacggttagtcgcagcgataataataataccttcactaccctcaaaaccgtccatttctacaagcatttggtttagggtctgttcacgctcatcgtgaccaccactaaaaccagcaccgccacgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcatttgtagaagctatgattgtacaatcctcagaaataagggacgatatggattccataatcatatgatattcatccaaaagaaggttttcatctgatgtaattgagataactgcaccatttatttcttttattttcttgtggctttttgataataaatgagtaattacatcatcagcactaattgtctctctttttcgctctatttcaaaagagtaaaagtctatttcttttgcaccataagaaactgttttaatatcttccacatcaacattaattaaattattctctgaaatcaaatctattattactgtaatagcatcaaataagtccgtctctttaagtaacatacagtctactggtaatggcttatttaatgcaataaggatatctatgcgcttttctaaatcaagtagccacttatgacaattactatgcagactttctcttcttgttggtaatacgactacagataagcaatcaaattggaatgattttgcaaactgataacacagctgtaaatctctctcattattttctacaaacagaagtgagaatgcttcagtatccactgccataacttctgtaagttgctcaatataatgaaaagatgtaacaagcggtgaattttcgtgattttttacgaactcattaccttgcaagcctatgccggtaaattgcacttttttagacatatagatctccttgttgattggagctattaaatataatggttaacacgacaagatatgtcgcatgaaaattactttaaggcttgttaatgttttgtgcttataattttatacctagcacgcaaaatgcgtactaggttacgtatagttgagtggctttgccactctaattctcagccccaaaggggctgaattatgcgtaacccagtacggctctgacgtgctgggatattaaataaacacctcttgatgattttgcaatctcaaaacatcaacaagccctagtttgtgccaaatttctttttcgccgcttcaacaatttcgttaaaaatcggatgggcttcttttaacgtttttaacgcatcacgaatcggctccattgcatcttctaaggaatcaggatagttttcaatgactagcttaggatctaaagatttaattggtagataaaaatcatagcctttagtattaaatttaaagcctaattttcctagctcaggatattttttattctgttctatcatgaactctttccaatctttattgccgcattttgggaattgttttttccaactatagaatcctaaaaccattccttcaacttttgaaaataaagaagtaatcccccaataatgaatttttttacccgtttcatcacattcaaaaccaaaataataatgagcgtagcaattatttgcatccgtatcatctgacgaatttgctaaccagtatgaaggataaaatgttgaaaatctattttcagcagaattaaattttcctttacactcaaaatcaaactcgaactctttaatcacattatctacagcattaaaaagctcagaatcaaagtcatcattaattaaatgtgaagcttcatcaaacatctgaatgttttcaatgattaatttgaaagctgcttgtctactcattttagtttccctcatattaaaaagttaagatgtgttctacaaactgttcggctaaccataaactgcggttatttggattttttcttagctcttgtcttatttgcttctgcaaaactttcgcaaaatgcgtccaagaaagacctataattttttctttatccgataaactttgtttatcttcctgatcatatttaacaataccatcttttgttaaataaataattttccattctcttgaacctgcttttattttggcaacatcatgatatctttttagctgctctttaccttctaaagcatcaatttttacctcaataaatagcaacacttcgtcagattcaatttcaatatcgactcgttcactttcatctcctaaaggacaacattcttccgttgcccgataaacgcttgggaaaggaaaggatgacttatcccaacctagactgtcatacaacgcttttaagaagaaacttccttgtccgtgatcttcatgcatatctaaaaaccagcgtaaaactttactattgcgaacctcataacgccccaagtttgcggttttccatacattaaccttcatgcctaaagccttttcttcttccatcggtactcgtgcttctttatactcattaaaaaagtattgtaatttttcacgatcaggaatcactaattcctttttttcttccgaaggctcaagaaaaacaccctctttccacattttaaaaaatgtagctagttgagcgatgtccaatgttttatctttatcttgattaaaatttactgataaatgcatattttacccttcaatcaaatgattaaatcttgttataaactgattatattcagcaatgcgacaagatatgtcgcactaaacactctctttctgaatatcccaaatatcttctccaaaacgtcttatccaccattgcaacatatccgtatcggcaacggtcgcttggaaacggtaatgttcttcgctttcttcgagtgtaatttgatcttttgaaagtggcgtttcggttaaatggaagccagcccagcgagtaatggaaaatgttagtttcactttcccaccactgccaaaacctaaattcccttcatcttggtactgttttaagttaaagtcttttgggcgttcaaagctaaaggttgataattcagcttttttgatacgatgtaaggcaagtaagcggttatcgtcaaacccatcataacgagcgactaaataggtgcttgccccttgttgtgcaattgccaacggcataatctgtgctttatgttttttgccggcttggttttggtattcaatatgtagtaacttattttggaaaagtgcggtactgacagctgtaaaaacgtcctctttcactttggctgggataagtggctggctagtcggtacgctacaaattttcccgagccactgatgttcggggttactcgtccctgctcccacaattttttctgcctgtttaaaaaagggttccattgacgacataatattcgcaggcaagagatatttaagttgctgttccgctaattttaagattaacgcttgttgttcgttcaacatcggcacggaaataccgactgatctctcaagccaacaatacgcatattcattgtcacgatcatcacattccaaatcgtcaaaatgctcgcttaaggtttttaatgcacgctgaatacttcgcttatctttttcaaagcctgcctttttcatactttcgaatatctcagacgtagttaaacgataaggctttttggggatacggcgtaaaatctctaataaaaagagtgcagaatcaattcctgatgggcgtttgggcataataatctccgcgcaataaaattgtggtagttttatctgttgcattgaatgaaagcctaaagcccttgtaatacagggataagttctggctgttgctcaataatcgcaagcaatttccgtgcagcgccatttggggttcgtctgccgatttcccacgactgcacaagattttggcttacgcctaaaagggaagcaaattccgcttgtttcatctggtgctgggttctaatcgctttgacattcgggattttatggatatgaatacgatgcggtggtacttctatttcgcctttttcaatggcgaccatttcttctaaaccttgaataaggcgatcaaataatttcttttccattattttctcctgttaatttagctacaacggtacgcattatcgctttttctttttcattcaaattatctttttcacttttgctatacatcgtaataaggtaaattctacccttagtactccatacataataaataacacgaacaccaccacttttgcccttgttattactttctagtttccagcgaattttttggcaaccaccagtattctgaataaaatcgcctaattcgtgagattctaataaataagcctgaaatttctgatattcatcatcagacattaatgcttttcggtcttcttcaaaaactttggtttcaataaaagtaagatattcttctgtttccattcaaacaaccttagtataacgtacacagtacaatttttcagctattttatagcctaaggtataaaaatattttggctagcttgctttgctattttttcgatagcgatcgaaaaaatcataaatttctcagacagtctgcctgaaatccgctataattttctagttatatcggtgcatttcgcaccgctttttatttttatcaatacgagaatctatgttccaaaataaccccctattagctcaattaaaacaacagattgaagcaagcaaagaatatgttgaaggcgttgtaaaaacgtcagataaaagttatggctttttagaatgtgagaaaaatagctatttcattccccctgcggaaatgaaaaaagtgatgcacggcgacaaagtcaaagccgttgtaaagcgtgacggagataaagagcaagttgaaattgactcgttattagagccaatgttagaacgttttatcgctcaagtgcgttttaacaaagacgggaaattgcaattagccgttgatcacccaagtatcaataattttattccagccaatacgcagaaaaaagtgacagaaacccttgaaaatggcgactgggtggtggcacagttgaaaacacaccctcttcgtgatgatcgctttttctttgctcaagtcactcaatttatctgcaaagcggacgataatttcgctccgtggtgggtaacattagctcgccacgagcaacctcgtgaacccgttgcgaatgagaaaagctatgaattacaggatcaagtcgatcgagaagatctcactcacctctattttactaccattgacagtgccagcactaaagatatggacgatgcgttatacgttgaaccaattagcgagaacggcacgcaaacaggctggcgtttagtcgttgcgattgccgatccgaccgcttacattcctgagcaatccgcgattgaaaaagccgctcgccaacgctgtttcaccaactacctccctggttttaacattccgatgttgccacgggagctgtctgatgatctttgctctctcgtgccgaatgaaaaacgccctgcgttagtcggctatattgaaacagatttaagcggtaatgtggtaggtgaagctcgctttgtgtcagcttgggttcaatctaaagctcgtttggtctatgacgaagtgtctgattatcttgaaaaagtcgaaaatcactggacaccagactgtgcagaaaccgcacaacaaatcgactggttgcatcaatttacccttgctcgtatcgactggcgtagcaaaaatgccttgctatttaaagagcaaggcgattacagctttgagttagctgaagacggcgcagtcaaagcaattcacattgaatatcgccgtatcgctaaccaaatgatcgaagaggcaatgattattgccaacatctgtgccgcacagtttttagataaatatgcacacacaggtgtatttaatacccactcaggttttgatagcaaaaacctagagcctgctcgcaaattcttactggatacactttccaatgatgaaaatcgagagagtttatctgaacgctactcccctgagcgtttaagtacccttgaaggctattgcgaaatgcgtcgtgatattgagcaattccctgaaaatttcttagaaatgcggttacgtcgctatttaacttttgctgaatttaaagcaacctcagctccgcatttaggtttaggcatcagccattatgcgacttggacatcgccaattcgtaaatatggcgatatggtcaatcatcgtttaattaaacaagtccttgcaaatcaaacagcaaaacctgtcgaagaaaccgttttagctcgcttacaagaagctcgtaagcaaaatcgtatggttgaacgtgatattgccgactggctttatgctcgttatcttgcgccaatggtagaacaaaacgtagaatttgacggtgaaatccacgatgtttctcgtggtggtttgcgtgttaaagttattgaaaatggggcttcgatttttgttccgttctcaacattacacaataacaaagaagaaatgttatttagcccagaagagattgcactctacatcaaaggcgagaaggcttaccaaatcgggcaagcggtgaaagtgaaacttaaagaagttcgtgtagaaacaagatcggttgtgggtgacgttttaatctaaataagattcaaaactatttccatgattactctcctctgtcttttatgacacttttatgaacatcaggtaagaaaaaattttacctgatatatatttttaagggaacaaatatgttttataaaacttattcaaaaataattttacttagcaccctaacattatttactgcttgttctacaaaaatatccgagcagcctaatacagaaataacaaaattaggagctaaatttcaccaacgtaaatttattccatctaatgtaccattagtgaatatatcggatattcagataaataataacattgttaatcaaaaggattttttacaacaacttgctcatattcaaaaccattcaactaacctaatgaagcatcatgtaaaaacatataataagctctttacttggttatcccatggaggaaaaattaaagatttaaaacattacggagtccaaattcaacaaatgcgagggcaggatgggtaccaaaatgtactgatgacaggctattatatccctgtaatcccagcaagaatacgtccagaaggtgaatttcatcatcctctttatgcaattcctaaaggaaataaaaaatactcaagagctcaaatttaccgcggtgcgctggctggcaaaggtttagaattggcttatactaattcaatgctggaaaactttttgatggaagtacaaggtagtggctttgttgatatcggtggtggtaggctacatcatttagcctacggagataaaaatggctatgcttacaccagtatcggtcgtttgttagtagaagatggagaaatagcgaaagagaatatctctattcaagcaattcgtaaatggagtaaagaaaatcctcacagattgcagtcactactggaaagaaataattcttttgtttacttccgccgagatccaacactagaagtaaaaggctcagcaagagtcccattagttcctttagcatcagttgcatcagataagcgcctcattccaacaggaagtgtattattaattgagatgcctatacttgatcacaatggtaactggaatggtcgccatgaattccgcctaatggtagcattagatgttgggggcgcagtgaagggacaacatttcgacctttatcaaggaattggacatcaagcaggacaaaaagcaggtcatatgaaacattatggcagagcttggctactaaattaggaacataaaatttgatttttatcataaaaataaaaaaattatgtttttatgcaaataaaatttggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgatagtgctatgcgaaccatctgtataggtaatttttacatcgccatttgtttcatttaccacattttcaattaacttacccttagtggcaatggtgatattaccgttctcttgagttagtttaatattatcgcctgcagtaaattttaccgtatcgcccattttgataagatgtgccgcaggtggatttgcttgaccagcccctttcgcaatcatcagtttccaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaatttgaaaaactcaaaaaattgatgtaatcttacagcaacaaaaataagtgttatgtccaataacccaaatcacaaatttgctttccgagtagcccctgttataggggctttttttatgtttttcaatttactttatgagactttttccatttccaaaatacaatggctccgccaatcaataacataagccaaattgccatctgtcctttttgaatttgttgatgtagccagtctaggttttttgcaccaaaatcccctaaatagatccaaatgggtacggaaataattgctgcaaagaaatccactaacacaaagcgagtaaaggttactcggcgtgtgatacccgaaaccagatacaccacagcacgaagaccaggtaaaaaacgtgctacaaaaagcaatttccagccctgtttttcaaagcgttcctgtactgttgcgaagcgttctggggttgcaatgcggcgaataagaggaaattgcaaaatcttctcgccgtaaatacgacccaaccagtacatggtactgtcgcccactaatacgcccagcatactgacaaacaacatccaatgaacattggtgtatcctaaaccagaaatcaccccaccagacactaatgtgatatcttcaggaataggcaaaccaaagccacaggcgagtaagactagaaatactgcccaataaccatagctgctgaaaaactcaattaatagttccattctaacgtccttattgatttaggttgcgaaccgaactacgcaccactaattctggataaaattccaatactttaggagtaacaggctcagacggttgctcattatgctgttgaatacgctctaataaggtatcaattgccatttgccctaaacgtgttttagattgatgaatagttgtcaaaggcggtgcatagaaacgtgaactatggatattatcatagccaatcacggaaatatcctgcggaacagaaagccctttttctgtaatggctgaaatcacacctaacgccattgcatcacaaccacagatcacagcggtgggtaacttatcctgtttgagcaaattattcatactttcataaccgccctcaggctgaaagtcattttcaaaaatccactctttgcggatcaacagacctgcttccgtcattgccttaacaaaaccatcataacgggcttttgcggttgttttataaagataacccgcaataatcgcaatatcacaatgtccattatcaattaaatgtttggttgccatataaccaccatcaaggctgtgatctataatacggtcactcttaccatcattcggaccccaatccataaccaccataggtacattcgtgccattaaataacgccaaggaattttccgtatattcggaacacattaccaaaatgccatcaacccgttttttaattaacatatctaaatggttttgtactttttcagcatcattttgggtattacataaaaatagcgaatagccttgacgatagcagtattcttcaacggcaagcacaatttccgcaaagtacggggcttcgcttgttgtgataatcataccaattgattttgttgtattcacttttaagcttcgagcaacggcactaggcgagtaatttaggctggcaatcgcatcccatacggcttttgtagtatcttctgccacaaagcgagttttattgataacgtgagaaacggtagtggttgaaaccccagccaatttagcaacatctttgatagtagccatggatattcctcctaataaaaattgggttctattataacgaaaattttctaaaaattactgaatttaatctttatatacgtactaaaatacaggaaatataacaaacccgatgagttaaaagaataaatgtctattcgccactaactgctcacgggttaagctaaacacccctaacccaccatttttaaattcaagccagtggaatggcacgcttgggaattgttcaattaaatgaaccatactgttacccacttcacagactaatacgccgttatcggataagaaatctgccgcttgagctaaaatgcgtttggtaatatccaagccgtccgccccagaacctaatgccatttcgggctcgtggtgaaattcttctggcatatcgtctaagtcttcttgatcgacataaggcggattagtcacgattaaatcatagcgatcttgtggtagatcgttgaacagatctgattggaatgggaatacacgatgagccatattgtgtcgttcaatgttgatttcagccacatttaacgcatctacagagagatcaaccgcatcaatttcagcatttgggaatttgtcggcacaagcaatcgcaatacagccacttcctgtacacatatctaaaatgcgttttggttcagctcgtaaaatccccgtaaaaccttgttgaattaattcgccgataggggaacgtggcactatcactcgttcatcaacgtaaaactctaagccagagaaccacgccgaatttgttaagtaagcaacgggtttgcgtaagcctaaacgttgctcgaccatttcaataatacgttctttttctacacaggttaagcgtgaagcgtagagtgtttctggcacgtccattggcaatgcaagagcggttaaaaccagttgattggcttcatcccacgcattgtcgtgtccgtgtccgtaatagagatcagaggcgttaaagtagctgtatgcccaacgcatcatatctaaaatagtggcaagatcgtcagcaacaggcgatgaagcgatttcatcaagaagttcaaggttatgttcgtacatatttaatacctattttgaaaaattgccgttttataccatatttccctttgtgttagaatgggctgattaatttaaaaggaaatattatgttagaaaatgatgagttagctttgtttcgagaagcgattaagggaacaaagaaaatcaaacaagatacctttgttcctaaagttgaaccgcgtaaaaaaatcaatgagatcagagaattaaaagaaaaagcggatacattgttttatttttccgatgaatatgagccgttattaaccgaagaaaatgataaagtgaaataccgtcgagaagatgtcgatccttatattttaaaacagcttcgccgtggcgactttcaccctgaactctttttagatttacacggtttgaccaaagaaaatgccaaaaaagagctggcaagtttaattttagcttgtgagcgagaagggatttattgtgccagcattatgacaggctatggcacaagggcgttgaaatatcaaatccctcgttggcttgtccaacacccgaaagtgattgcgttacatcaagcaccaagagaatggggcggtaactccgccattctaattttaattgagcaaccagaaaaattagataaaaaacgataagaagctgtctttttaccctaagaatattccaataaaggcatagagacaaaattaaaggaacctgatatggatctgcaccccaaagaggtttggctttaccaattaactaaggtgcagaatagaaacctaagcaatatacctctaaccagcaacagtaggtaaaataccgttttgcattaggaatgggataacaataatcacaatacccataatgaaagccaaaattaaaccgatagaaccacctgctacacggtaaggtaagttagggtgtgcttggcgagctttccacgctaaaccgataggtaaaattaatccgtagaaagcaaagagtaaacctgcataacctaaggctgcaataaagccatttggatagaataaggcaaatgcaagcggtgggataaaggttaaaggtgttaaaatcgctcgatttgctggcaagtttacacgttttagtaaatcgccaaccccttcaaaaatacccattgctacccctaagaaggaggtgattaaagccaacgctgagaaaatacgcaccatctcgcctaaaatggtactgcctgtaatttgacttgttgctttaactaagccatttagggttggatcttggtttaataaggtgacaaattcgccttggcttaatacgccgtgtgttgctaactgccatagtaaataagcaccgagagggatcactgtaccgataatcaccgcaattctaattttacgaatatccgcatcaaggtagctattaatactacccataataacgtggaagccgtaagaggtgaagaaaatcgggatcactgaaataactaataagttatctagtggcactgcggttaagttctctaattttgcttttggaaacatcattaacagtacaaatacaaatgcaacgattttaccgataaaaagaacacgagttaaaccgtctacccctttaatacctacgacaacaaatacccctaaaataaaggtgaaaagcaaaatgccaacttttaaggtggtatcaccttctcccatttcaggtaatagtcctgaaacaagagagccaccgcctgtaatgtaggcagctaaaagtgcataaagcagtacaagtaagcacactgtcgctaataggcgaccaggcattccaaaatactgttcagcaagggttgctaccccaacatcttgctgtgcggcggtctgatagacttccataaacagtaatccagtataagtgagaagcaaccataatcccaccaacaataccaacgtcattccaaagcccattcctgcggaagttaatggcattgctaacattcctgcaccaatggttgtgcctgcaatcattaaggcactgcctaaaattttatttttcataaaaactcctgaaataaaaatcctaggcattctagcaaaacaaaatcaaaacgtaacgaaaaattctcaatgtaaaaaaataattacactcagtgtattttttcataatacaaaatgacttaatttttgtacttgctattcaacaaattatccaaccacttttggtagccatccactttcaatcaagaatggtaccatcacgataaataccccaataactaaagcgagtaatagggaaatagaaccaccttttacttgatatggtaaatttagattttgacgacgtaatttccaaaccattgcaattggtaacacaatcgcatagaaagcaaacatttgcccagcatagcctagagctgcaataaagccttgtggatagaagaaggcaaatgacattggcggaataaaggttaatgcacctaaactcactcttcctgcatttatatttacacgttttaaaagatcttccaatgcttcaaatagaccaagtgccacacctaagaatgaagtgatcaaggctaatgccgagaaaattcgcaccattgcaccaataattgaactgcctgtaatttgtctagcggcttcagctaaaccgtttaatgtcggatctttttctaagatttgtaagaactctgtttgggttaatacaccgtgcgttgccaattgccataaaatgtaggcaattagcggaatagatgtacccacaacaatcgaaatacgcaacgctttcacattgccttctaaatatttgttcaaacttggaattgaaccgtggaaaccaaatgcggtaaagaaaattggacttactgaaattaacagtgcattatcaataggtattgccattaagttatctatagatacttttggcaacagtaagaataacaccaagataaaagcgaggattttcgtggtaaataataaacgatttaccgcatcaacactggtcgtacctaaaataataaatacaccaaatacgagtgtaaaaatcacacctgaaatacgcgtagtggtttcagcatcaataatagttggtaaaaatacagcaagaagtgaactaccgcctgatacataagcggataaaatagcgtaaagaaatacaattaaaacggttgttgaaactatacgcccgaaagggccataatatttttctgccaaagtaccaagccctgcgtcactgtccacagtttgatacacttcaacgaataataaggcactaaagcaaagtaacaaccaaagtgcaaccaaaagtaaaaatgtaaaaccaaagccgatacctgccgatgtcaaaggcatagcaagcattccagccccgattgtcgtacctgcaacaattaaggtacttcctaatgttttgtttttcatacaattacctgtcaataaaaatgaacatgcatattttaattaaaatacagaatttagctagaaaaatcacacggaatagaaaaatatttctaaatagtaaactttcttttacaaaaaacatgctatctcaaaacagtactactgactcttcatcaaaagagaaaaagtaatatctcaaattataggtactttttattagaaaaaatcaatttactaaattatcgctttagcattatttatactcttagtagagagatagcataatgtgtgtaaaatatcttggggctgtcctagataacgactaaaagctctataatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttagcttataaaaaaataaacctaacctaacggttcattttatatttgatcgttagattaggttttattttttattttgagttaatactttcagtaatttgtgtcgttgataaatgccctggtacaacttttttaacgtttaattcagaatctaaaaaaacattggaagggtaacctctgactttggctcttttcagcacttcaccttgttcatctaatagtacaacgacatttttatagtccagtcctttataccattcaataaatttttcagttgatttttccccttttttatctggagaaacaatagtaataacttcaaaatttttattttgatcagcgcttaaatcatcaatttcagccaagccagccaaacaaatcggacaccaagatgcccacatttttacatagacattttttcctttatacttttctaaagaaacgatattgttatcgagatctttaaattgaatgtctgccaaatttttattttcttcagcaaaagcattaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttcagcaaaagcattaaagctaaatagcatgagaagtaagcccattatttttttcatcttatatttctcctatattacataaaactatgtaagttattagtgattaacaataatcccattaaaataattagtgttccaccaatgattttaaatttatctaagtgcttgttaagtgatttagctctttttaataattcatcagaaaagaatgaaaagataataaaaggtagggctaaacctaatacataaacaaacatcattgcaccaccgtatagagcagaaccttcatcgcctgataatgctagcactgaagctaaaattggtccgatacaaggcgtccagccaagactaaaagttaaacccaatacaaaagcttctacagaagcgcttttaccatttgttttaatttcaactaatttagtttgttctaagaaattgatttttatgataccaagttgatgaataccaagaataataacaataattccagcaataacacgcgtagtatcatttaataataaatcacctaaaaagccaaaactaaaaccaaggctaacaaatgtgagtgataatcccataataaataggagtgtatttaatacccttttaccacctttacttaatatgccaaaatagatgggcacaattgggaaaatgcaaggagataaaaaagaggctaatccagctaaaaatacactgctgatgagtaaattctggtcgaacattttattttcctttgattaagttaattaaatatccataattttctttttccatttgctcaagaggaataaatttaatagcagcgctgttgatgcaataacgcaatccacctttatctttaggaccgtcatcaaatacgtgacctaaatgagctttaccgctgcgacttaagacttccgttctaatcatattaaaactggtatctttttgataagtcaccacatttttgtcaattggttttgtgaaacttggccaaccgcagcccgaatcatatttatctctagaagaaaatagcggctcccctgtggtaatatccacataaagtccatcttttttgttatcccaatattcattactgaatgaacgttcggtattctttttctgtgtcacactgtattgtaaaggtgttaatttagcttttaattcttcatcacttggctttggataatctttaggatcaataataatattatttgcttgttctaaatcaatgtgacaataaccgtttggatttttctttaagtaatcttggtgatactcttctgctaagatgtaatgtttaagtggttcaacttccacttgaattttgtctttatatttcgtttgtagcgcttcaatttcttttagaataatagctttatcttgctcattttgataataaattcccgtgcggtattgtctaccacgatcatttccctgtttattcaggctagtcgggtctatgacctgaaaataatatttaagtaatttttctaatgaaattttattagcatcgtaagttatatgcacggtttctgcatgatcggtttttccgataatatgataatgcgttttatcggttttaccattggcatagcctgacgtagcattttttacgccataaatacgttccatataggcttcaattccccagaaacagccaccagctaaataaatttcacgaatattctcattttgagtttgtgtcattttactcatttccttacttgaattattagtatgatttattgctagagaattattagatatagcagacataataagggtaaataatacggttttatgagatttcatatattctccttcgaattttctctaattctgaaataagcagtagaggtattagtgtgtaaatatactactgctcgatttattagaattatttttagatggtaaattacatcttttcttttttcattttgtcagatttcatcatatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattccatcctttttcatatcatcagacttcatcatatgattttttttcatttcagaatgtttcatattttccatagtttggcaatctgctctcattttatttttgcaatcatccatcatttctgcatttgctgtattgattgtagcaatagaaactaaagaagttgtcattaatactttaagtaaagttttcataaatttttcctcttgtaaaaagatttgttaaggttaagataggttagtttttacgaaaagtttccctttcaccttattagtcggtgtaagagggaaatccttacaaaaatttttcatttttttagaaaaatatataacactatgattttaaaagaaattaattcatctcaaatggcagcaattagagaacaaatgctaaaatttgctcatcttcagctacgagacagtcagttagcagaagatatggtgcaagaagcattgctcaacgcacttaaaaatttagatagttttaaacgtgatgccgcatttaaaacttgggtatttgctattttgaaaaataaaattattgactatctgcgtcaaaaagatcgtttagttcttgaaagtgatttgcgagatgatgaaaacgatagcaatgtattttttgatcaagatgggtattggcgagaggagtgttatccacaagaatggcaacagcccgaaaatgccgtttattccgatgaattttggattatttttgaactgtgtctcactaaacttccagcaaaacaagcgcacgtgtttatgatgcgagagtatttagaactctctgctaatgaaatttgccatacagcagaaattagtcaagccaatctacatactttgttgtatcgttcacgcttacaattgcaacaatgtttatccagtaaatctatttttgggggcaaaaaatgaaatgtcaagaagtgacgaaattggtctctgaagctcaagaaagaccgttattgcttaaagaaaaaataggggtaagaatccatttattgtattgcccacattgtcgtaaatttgaaaaacattgccagcaaatgagccaattaatgaagaaatttgcagacgatcaaaataatgctgattgatgttttgtgtaataaagtagaaaaacaaaaacagcttgttatttttatgttagaatttctttcaatctaaaaacaggagttcaaaatgggtacatttggttatgcaatgatggccgttattgcttctttagctgtagaagatcaaacctaatctgacagtccccgcttaaaattaccgtgtctgtcagattaatttgagcttaaattcttttctgcccaaatcccttttccatcaagtaatgttgccatcggagttctgccacagcacatttttccttgatgtgttcgatggtgattataatacattaaccactcatctaaatcagcttgtaatgtcgctaaatccgtatatattttcttcctaaatgcgacttgataaaattcttgtaagatagtcttatggaaacgttcacagataccattcgtctgtggatgcttcactttcgttttagtatgctctatgtcatttatcgctaaataaagctcataatcgtgattttccactttgccacaatattcactgtcacggtcggtgagaatacgcaacatcggtaatccttgggcttcaaagaacggtaggactttatcattgagcatatctgcagcggcaattgcggtgttcattgtgtagagctttcaaaagcaaccttgctataagtatcaacaaatgtttgctgataagtaagctggaaaatccaaggcaaattttacaaccgcttgctcaatgtgctcgtctactcgatttttgatattcggtacccgacgagtttgattaagtaatgcttcaacaccgccttgctctacggcttgttgatagcgatagaatgtatctcggctcattcccatcgctttacaagcttgagaaatgtttccgagctcttctgctaaattgagtaaaccagtcttgtgtttaatgagcggattgtaagtaataaaacatgagagtttccttttttgtttagattgaattttagacactcatattctaaacgggaaactctcatttttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttcaggcaataaaaaagccccaagcatttctgctcagggctacaaaatcattttgctttatctcgcttgtacgagttgcaagcgtagctgaaatatacaactttcttcgccaccagtcaatcactttttgagcaattaaaccccatatagtttcttaaatattaaatgcttgattgtgtgtatttatgtgtatataattattattgattaagacaaaggaggaagcatgcactcaagcgacttaatcaaggaactaaaagaggcgggttgtttctttgttaggcacggaaaaggcgatcaccaaatatggcaatcgccgattacaggaaagcgatttcctgtaccacaccctaaacaagatttacctattggcacttcacgttccatcaaaaaatcggcagggctgttatagctctgccgagcttagcaaaggagagaattatgttatttaccgttggggtagaaactccacataatgagaacgaagcatttggactttgtgtacctgcactatttactgatgaatatagttgctttagtgcggccgatgcaattgatgaaattatccctaacgtaaaagatgccattcatacaatgttagaaatgatggtagaagatgagtttgatattagtacgcttcaagataagggatttgtccactacaaacaacaagaagatttttcccactgtgatagttggttgcttgttgatatagatatttctgcattcttaggtaaaaagcaacgggtaaacattgtgttaccacaatatctattagacagaattgacaatcgtgtctcacatagtaatttttatcgagatagaagccattttttagcagttgcttctcaacgtgaattaaccgctcaacaggtttaatggataggcgtagcaatacgcctaaaacttcaatctaatcaaccccgaaccaaataccgctccttccataaaatctcgagctgtgcgtagtcgtctgtcaaacgttctcggtgaaatatgcatctcaagacaaatattcttcttgtcttgcccctgtaaaaacaccgccattaacacctgataggcttctaagttcaaatcgtgtaacgtcatcacagcttcatctagcttaagataatgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaacttgccattcgttttacgctcatttgagccgtactctcacgaatattcactaattcgccttccaatcctgtgaccaaacaagaaccttctttcgttgcttctgcgtgagcagaaattaaaagaaccttccacgcttcaagcggtagccattcgccgttaaattgcacctgtttagcaatatcgccgcacattgcgtggaatttggcattttgctcaaggttgcgagtaataggcttcacttcaaccactaacggctttttctcatctattggcaacgctttcacaaattcaagggcattgtttttaatttgctctgagcgtaaaaagtatttttgtttatgctccatacctaccaacctttgctccatacctatcaacctccttacctaccaacctgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttctaaaatacccacctaccttcttaataaaatccaaactcatcttctccctctaacctgtttcaacaaaccaccccagaaagccctcaccttttcactattgactgctttcacttcttgaggtaatgccagctttggttctggtaaaacttcccctgtttttaaccgcttgctcattttgacaagcgattttttaatctcatctttgagttgcttatcgctccattcgccagtccgacaacgcacatacaagtcagtaatcaggtaatactccacagtagagacaaacttaaactgctggatttcttccatgccaaacctcataaacgcttgtaaccgctggtaaagtctatcttcatcaggcaaacctaacgcttcgtagtccaccgttttgcaccactccacaaactcgcccacacttggccagaatggatttttagattttttcgctcgctcaatcccgttttgcagttgctcaatcgtcgtaattttttcattcaccaacgtttcaagccaaatccgctttgcttcacggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattaacagctctaatcgcaccgtcaggaattgccgttgcctttgctggcacttggtaatttggctcttgcccgacaaggcttttcaagttcattgatgccacgttttgcattaacttccccttaccgtgatagacataccttccgcccagttgccttcgtcatcagggataaacggcttggaagtattacgagcggacggattttgtggattttttgcagaaactccgtcatctcgccaatcccaaccagcactaaacccacgccaaccacgctcaatcgaaattgcaatggcttgttgaataggaattttggctttgtccgcctcacgctgaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcttttgccagttgttcggtaatcccaaaactttccaacaaaatcaaatctgcggattttttctcgcgcgcgtttatacttcccgtcagggaagtattattgttagtattctctgaagtattctctgtattaacgaatggcggttttgcttcttcccgaatgtcgctttccgccattggggaatgttcattagtgacattgggtaatggcggttttgcttcttcccgaatgtcgtccattaatgcatcaaatttaactaaatccagtttgaaataaatgcggtgttctaagcgtttgtgagtttcaaccaatatgcctagctcaactaattttttgcgagctgtttcttgctcacggcgacttaatcccgtttcctgctcaagctcagcttgtgttttatatacgcctaatgggtttgaggtcttatccagccaaaagaataattgcccaaataaaattgccgctgtcacaccgcctaacggttttgctaattgtggatagtacgcaataggctgtcccagttggcgtaatttttggctaaaactcataatcccaccaccttatcttgtgtaaatacgccattccaatttgctttcatcggtaattctcgctttgtgtaccactcatagagctttgccgcccctttcttgagtaaaacaggtttatatgccacaaacggatcttttccgtgttgcgaaatctccgtcgtttcttccgtcaaatactgatcacgagcgtacgacttcacacgtttatgattaccatcttgatagagccagtttttatccactaaaaacgccccaattttcaaagcgttcactccattcaagcctttcacaaactcaaacggtgaaatcccattacggaaataactttccattgaggcaatttgaagggatttttgctcactctcttcgattttatcggcgagttggcgtaatgcttctgaatagctagggagttgttgcacttgcttttgctctaactcttgccaacgatcaactaaacgagcagtaaattcaggagagaattgagccacaatcacataagtatcacgtttattaatatgatactcgtaatagacttgcccattttgctcatgggtgtacggactttccgcataccccccaattacccctttattcatcaggtttctaatagataagcacacatcacggtgtctgctttctgtgattcgtgcaatctcccgactactcatcgttagggttgcattttctctctgattagtagataataactctgttttcataaacattatttccccattacccacgttgccgcgtgggtttttattttcaataacatgaacgcccttctctgctaatagcttaagtgcgtctagttcactgtctgtcaaacgattcaaacctttctctgatacctccaattctaaaaaatcaaggtaagcacagaatttgtctaaatgttctgccttaaaacgacaaatcgttgaggcatcaaccccaacatattctgccgcttgagcatctttcgtctatgatgccttctgtctgattaagtccgcaatcttcattgcagacttgcttaattcattgcgtgccattgcgtacctcatagggtaaattaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccatcaaaacgagctacggctcaatgctctttaacaacacgaataacccacatcaccaaacaaggttggtcgcctgtaccagtggggctgaggcaaacaggaattgctattcatagcgacatttacagagaactggaacatctcacatcaatgcggatttatctacaacgaactgagatcggaaaggaaatgttagacaagtgtcgctatgaatgacaacaaacagaggacacggcaatgactaaaatcattatcgaacgtaacccaacaagcaacaaatactgcgaaaaagcagaagttcgcacaacgggtaaagctggcagactggcgagaatgttcgcaaaaaatcgcaaaaaacagaccgctaacaccctttcaagagtagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcccactgtaacaggtgggtgtttttttgaggtaaaaaaatgaatacatatgcaaagttctgcccaaacgtatttttagcaaaatgccaagagcagcacgaaaagaacgaaattattaccgtgacaagtaaatacggcaatgaaacagaggttgaaatacacaacctcgttaaacaacaagggggattttatttttactcttttgtgcgttgtgatgggttggatagtcaagctcgagccacagcgaaagcacaacgttatcaagaatatgctgataacgccgcaaaacgcagtaatcaatattgtgaggcggctaatgaggggcgtgactttttaagtcttgctgagccaataaaaatcggacatcacagcgaaaaacaacacagagccttgattgaacgtaatgctaaaagaatggataaggctgttgaagaaatgaaaaaagccgaaagttatgccgataaaattgcatactgggaatcaatggctgaaaaaattgatttatctatgcctgaaagccttgagtatttcaaacataagctaaaagaggcagaagacaagcattcggacctaaagaaattccgtgaaaaacgagaacattcttattcattgacgtacgctaaaaaagccgtcaatgaatttaaagaaaaagtgcgattggctgaattgctttgggcttaacgaaaaatcacccgctaaacaaggggatttcagtctgtgggattgacgcctacggcccattcggattaagataactgtactttcaagccgtctaccaacggcttttttgtatctgctctgaaggaaaacgtatggaagaatttagaaattattggataaagcctgtcgataaaattggtaatggtagttttggaacggtagaaagagttgccgtctataataaatcaaaaacaatatctaaagaattcgcacgaaagcatttttcacctagagtacaaaattcacaagaacttgatgaatataaagaacgtttcaagagagaagtaatatatcaagcagaatgttttcatagtaatattgtccatatttgtatgtattctcttggagaacagccttggtttattatggaacttgcagaagaaagtttagcagatacgcttgagaaaaacagctatttggatagttctcaaagacttagttattcagacaaattgaatatattgaaaatggtgctatctggactgaattatctccataaaaaagggttccttcacagagatataaaacctgaaaacattctaaaatatccaaatggagaatataagctctcagattttggattaatcaaaaatctaaatagtgcatctactgctcttacgcaaattggacaaaaaatggggacatcacagtatatgtcgccagaaattttaagtggcggtgattattcaatacaatctgatatttttgctatcggtgttgtaatggaagaattacagctagactctaaatatgataaaatcatgcaaaaatgtacagctagaaaacctaaagataggtatatgtcagtgcaagaaattattaatgatataaatcatttgatgggggaataattcaatgattaacttaattgctagtgcatcattctcttttccaaaagaacaaatacggcaaaatcaagatcatattctatcttgcactaaacacaataacggttacttatttgcagtggctgatggtgttggaggatacaaaggcggagaaattgcctccagaatcgcgatcaaaaacctagaactagcttacaataatgtattttccgctagtttggctgaaattaaaaaacttgacccagaatataaccaagcatctacaaccttaacatttggttatttaacacaagaaggattgtgcatagggcatattggtgactgtcgtctatatataaagcaaggtaataaacttcgccaaaaaacgaaagatcacacaactcatcaaaagttatttgatgaaaaaatctatacaaagaaagaattaaaagagctatcaggaaaaaatgtcatcaccacggcaatttctacacaagtcgaaatgaaaccagatgaattctttattccgatgtcagaaattaaggatgagaataatgaggtctccatctacattatgtcagacggtgctcatcatttttgggaacatcgcccacgcttctctgaaaaaacgatgaatagcattgtgaaattttcagcaaccttacaaaaaagaatagagaaatcacctattgatgattactctctcgttgctgttcaatttaaaatctcggaaacagagtaaatcccattgacaaaaaccgctacttcggattaagataaccgcactacacaacgaaagtcggttactcgctccgatacaaagcggttttttttgtacctaaaatttaggtagcgatcagttatgatcgggtcgagagagcctaatacaatacccttgtggaaataagctccgccatctttcgttggtagttgaagcccgatcacctactaagtgatcgactactgaactaaaacgaaaggtacaaaattatgtcaaatcaacttactttccaaaacgtagcattaactgcgatccaacgtaacaaccaaacttatatttcatcaagtgatttagcattagctttacaatatcaacatactaattctattgctaaaatttatgaaagaaatgctgatgaatttactgccgatatgacaaccgtagtcaatttgactacgaatggcattaacggttctaaccgccaaattgagcagagaattttcagtctgcgtggttgtcacctaatcgcaatgttcgcccgtaccaaagtcgccaaagattttcgcaaatgggtgttggatattctcgaccgtgagattttgcaaaatgaacaacaaaaccaaccgcttgtaaaacccgaagtccgctatccggcttcgtttaccggtgcggaaatctacagtctcgtttggttacttatctcacaccgcaatatgaacgacctactaggcgaactcgaacagcccctagcagccatcggctcaaacttccaccctgcggtgtacagccatcatcgagagtacaaacgcctcattgatgaaaacttaccaatccttaaacgcctcatcgaaccgtttaaggaaagcaacccaattgaatttgagcgtatcaaatcacgattaaaacttaattaaacccaaaacccaaccccaccgcactttccccgaaagcctgcggtggcttcctacacccaaaattcaacaaaaggaataaaaaatgaagacacttatcaaaaaactcaacctgaaatacctactcggtgccttgcttatcgcctttgtgacaggcggaagtttaactggctgtgaagagcctgagcctgtttctagcctgcccgtagaaagcaattgccaagcagaaaagatttggacggaagatgacttcaaacgagctgaaatcgccactgaagaagtgaattacaacgcattagccctacaccttccaccgcctgataacgttacaggtgaagatgtgaagctgattaaacaacataaccaaaaccaacttaacaaactgattgtaggagcaaaaagatgatcaaacttcaaattttacaaaacccaaataaaaaatacttcggtgaaatgtgggtggataaacatctagtgtttcaaggcataccaatgacatcggaaattattgctatccgaaatttaaacaaagccattgatagatataacagtcaaaaaggcttagtcggtaaaagagctatccctcactaccctgaaatcgaagggcataatccgattgtaattgagcaagctaaaaaagttgggctaaaagtaacaattatagaagcagagcaggttgagcaaatagcaccgacggaacaagttgagattgaaacagcaccgacggaacaagttgagccgaagccgaagccatcacagcccaaacgcaaaccatttaccccttacggcttaaatggctatctcgtagataaaaacggcaatgtccgcctaatgctagacagaagagccaacgccaacacgattgtacttgaaccgcagatgttcggagcattagcggaaatggtgaagaaaacacaggagcaacagaatgcgagtacctgacccaatgcgatacgaaaccaaagatgattactacaacgcactagaaaagtttgaggcacatcaacaagcgaaatataacgatgaagtcgtccctgatgaatgggacgagttttgcgaagaagttctcatctgcaatccaagagaacgagattatcaagaccaaacttggttatttgggagaaaagacgtatgaccacacaaaccacaccagcaactcaaaacaaagaaaacaaattcccgattaagactttatttgaaagcccaaacgtacagcaaaaattacaagcattgcttaacaaaaacgctgcgacatttaccaccagcgttctgcaaatcgtcaatagcaacgcaatgcttcgcaatgccgatccaatgagtgtatttaatgcggcgtgtatggcagcaacgctcaatctaccgctacaaaatggcttaggttttgcatacattgtgccgtatcaaaatcgaaaagagaaaaagacggaagcccagttccaactcggctataaaggcttaattcaactggcacaacggtcagggcaatttaaacgccttgttgcagtgccagtttacgagaaacaactgattgctgaagacccaataaacggttttgaatttgactggaaacaaaagccagccaaagatgaaaaaccaatcggctactatgcttatttcaagttgatcaacgaatttactgccgaactctatatgagtacccaagacgtgtacgaccacgccgcacgctactcacaaacctataaaaaaggttatggcgtatggcacgacaactttgaggcgatggcaatcaaaacggttcttaagttgctactctctaaacaagccccactttccgtagaaatgcaacaagcggtactggcagatcaagcggttgtcaaagatgtagaaaacgcagaattttcttaccctgataatgaagttcaagaagctgaatttaccgaattaaaagtcaatgatgacgtgtttgaaaaatgtaagcaaaacatcatcagcggtgatgccactttgcaagacttatgcgataacggctatgaattcagcaaagagcagtatgcgattttagaagagctcgaaaataaaagggaatgattgacacccatcaaattaagtttaatccaccatcatcacccaaaggaaacacaatggaaaaaatgtataacctaaaagtccgttgctctcaacttcaccaactaatgagcgagccacgctcaaaagcagataaagatgcgggcaaaatttccgatactgccaaaaatgcggtgcgagagattgcaaagtttgacttgttcggctaccaatcctttgacggcaataagtacaccgaaaaaggcaatcagcttgaagagcaagccatcaaattaagcgggtttactcgtggtttggtgctaaaaaagaataccgaacgcagagaaaacgcattcatcacgggcgaatgcgatatttacgttccatcacgcaagctcattattgatacaaaatgctcgtgggacattggctctcacccgtttttccaagacgaagccgaagaaaaagccaaaaaagcaggttataactaccaaatgcaaggctatatgtggctttgggattgcgaagaagcacaaatcgacttcgtactcttccctactccgcttgatttaatctcaagctacgacaacggcgaaaagctaatcgacctagtagagcaaattccacaatccaagcgaattaccacagtcaccatcaagcgagatgaagaagtgattgccaaaatccaacaaaggctcacctcagcacaaaattattatcaacaaatcattcaggagtatatgtaatggcaggcgtgaataaggtaattatagtcggcaatctcggcaatgaccctgatatgcgtacaatgccaaacggtgaccccgtcgttaaaattagtgtcgccacatcggaagaatggaccgacaaacagacaggcgagaaaaagcaaaataccgaatggcacagcattaccgcttttaggaaattagccgaaattatggggcaatacctaaagaaaggctctaaggtttacattgaagggaaacttcgtacccgcaaatggcaagcacaagacggtacagaccgctacactacggaaattatcgctgacaagctcgaaatgctcagtagttcgcaaggtggtaacagtaacaacaactgggcacaagaaccacagggtaagccaaaacagcaacaacaaacaaaacagaaagaatgggacggttatgctgatgatgaacgtctgccagcaaataactttgatgatgaaatacggttttgagtttaattaacgcccttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgagggcgttttaataaagggcattacgcccctttctgcgattgcttaaacagctcaacggcttgaataatcaactgattttgtggaatatttaactctgtacttaactgctcaatttcagcaatcacaactaaaggaagtttgaaggctttgagtttaataccgtgtttttcctcactgcgtttaacaatttcggttcttgacatcgccataataaatccttaacattagttttgaagaacgagagagatttctccctctcgttaaattatcatcaaattagtaagctggcgagctaagtactaacaagatgataactaggataatgtatttaaacatttgattatcctcttcaaagttgggtagattaaaggtcagacccagctcgttttcagcattattactgaaaacaaagttattataagttagttatctaactaaatcaagcattatttcactaagccatcgtttttacggtggcttttttattgcaacattttcacgaaaaccaaccgcttgtagcaatacaggcggttttttattgcaaggaaattaaaaatgacagaacaaactacacaaaagaaatacgaactactcaaagatgacacagtagaacatttaggcagaacgctctatcgaattaaagcacttattacatttggtttagttggagcaggccaattaggcggttatatcgaaaccgaaaagaatttagatcatagcggtaatgcttgggtgtacgataatgctcgggtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggactaggcagatgagctggttgatttcattaacgtgtttatgcttaattctcagcaccatcaacctgaaattaagtgtagtcaaacaaaaactagggaaaactctattttggatggcgctaatgaaagaataaggggcattacgcccctttctgattaaataactcaaccgcttgcacaatcacctgtgtttgtgaaataccgtgttgctcggcaaggcgttcaataagctcaatcgtttcttgatgaagtttaaagcctttgagcttaaccccacgcttagcttcgcttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccccccaatcgcaatcccatcaatcttagcattaaggctctgacttagctccgaaacactacggttagcacttgcaacgctattctgcaaggtagaaataccactctctacacttgctaccttcgttgttaatatcgctctagcctgtgcttgtgcattatccccagcaatacgtgcttgacgttcttcagataaacctgataacgcattatcggctttagcggttgctgtcgtaattaactgagcttgctcacggtcggcttgctccaatcggctcaccgcagtaccacgagcattggcttctgcttgaatcgcttgtgtgcgtcgatttacctcttgagctaacgcactttgtacggtgttagctttggataaggcgttattggctgtactgcttgctgtcgtaagttgattaataagagcttggtctaattgactacttgcaagttttccttctaaatcaaccgcttgtactttagcagtgtatttgttgccgtcccacacatataacttgccgtcagcttcgttgtacacttggttatacccaatgttttccgttgggttatcaatacgagcaacggttttagtcatctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacggttttagtcatctccaatttgcgtgcgggcattgcggtatcaaagacttcatcaataatattttgccccagcttttcattcaacaacgcaagctcggcatcaatatccgccccagtttcagcacttaaaccttgttgttgataccactctcccacgttaatgccacgagtgtgacgtaaccagtagtaacgtgtttgacgtggacctacattgtgggtgtagatattcgctatcactttcgcaatacgctctgcgttagcaaggttgttggttgaacttgcccagatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttccgtttgcgtggcttcgtccacaaaatcccaagacagcgtaatacctgataaaccgcccgatacccacacatttttaggcgcaggtggattgtcaatcgtaaaggattgtactttttcactcagcattcgcccttgtgcatctcgtgcaataattgtgacttggtattcaccatttgctaaatcagcaaggttcagctcactactggattcatcacgtttaaacagatacaactttccgtcttttaagactttgatgtcatatttaaccgtgccattgcctgaggtcacttcccacgacactttcatatcaccgctcaacgtcggttgtacgcctaagtgtgttaattgtggctcaactttatggcgtgtttcagacgcgggagcaaaaaccgccccttcatcaacaattcgctctttctgtggctcgtgctgtaatgcggtaatgccgtagctaccatcttcattttccgccacgccaagcacacgatagcgttgtgtgctgactaacggggtatgcaacgcccaagtatccattatttgtaagcctgttggctcgctatctaatgttacaagcgatttgttttgggcgttaatttgcgaaattttacgacgaactaaccgctgtccgttgttatcattgactaaataacttagatgcttttcgccctgaacttcaatcggtgcatcaagggtaacggttctgccgttaatggccaacacacgcccaccaagattgacgttagcgtaggatttatccgcaatttcaatgatgtcacccggtaatacttgtaacccttcacgccctacactaaagctgatcgtgcattgctctaagcgagacgtttcaagcacccacttaccataacggcgagcttgcccacgagaagtacaggcaaacgcaacgattttcttcacgttatagccataacgtttgatcatcgcatcatctgccacatactcaatcgctttttgatagttgttacgttcgtcggcatattccacttcaacggcggtaaaaatggacttaagcggtacatactggcgattaaatttaccgtcaataacgttcgcctgagtaaatgagcagacaggatcggcatttctgtcttgaatagcggttaattgcgtaccattccacaccacaatcgcacggaaaaccgacgccatatccgaaatcaccgaataagcatcacgttgctctgtcagccataaatttgccaccattctaggctcaacaccgccatagccatctggtacttgttgatcgcagtattgggcaatttgatacaactggaatttatcaatgccataatcgcctaaacgttgccccaagccagctaatttgttggtgactaaatcgtaaaacacccacgcaggattattggtccacgccagcttaaaatccccacgccataagccactgccataggttctcgtatcaggatcgtaattgctcggcactttgaccaaacgcccatacaaaagaaagttaatgtttggaaagctcgggttatagcgtgaatcggttttaatccccactatcgccatattgggatagctcaatttggcactaataatctccgtgtaactcgaccaaaatgtcgcattctgcaaacgttggcttttactgtcaggcgtaacacgttgtaccgtcaccgtgaaaggtcgtggtggtaaattgtcgattaaataactacggtgaaaacgtgacgatgatttaccgttaatcaccactgtttgtcgggattgaccgttaattaaaatctctagatgcaccgatgtgccgtgcgtatcgccttgatcgttttgactaaacaacgcattcacacccaaagtaattcgcaaaagatcaatatcagggtcaatcaccgtgcgagaaataggatgttctaatttcacttctgcacccacagaaacttctcgctctgacgcatcaaaatcttcaaggggttgctggtcttgatagcctaaacggtaacgaattaacgtattttgataattccactcccctttcgagtttttaatcggggtgtaatcaaagaaggcactctgatactgatctgctgtcaccgcaccacgaatagggccgagtgaaattaagccaatcgcacttaatcgctgtgctgattttaggttatcgggtgcttcgtaaggtgtatggccaccaccgccttttttaccgcccataatgtttctccaataaaaaagccgtcacagtttcctgtgcgactgtaatttgtttacgttgtcacatcatcaaaggtatcaataccctgcgaaatcaagataagacttgtcatcatttttccgtaaagcaacggaatcggtctgccttgaggggtaagattgcgaatgtttgagaatgatgtactttgctgtttttcgctatcacttaatttcgtgttcatatctggtggacgagcaagcatttgcatcgcccctcctaataaaagactagctcccatacttcccatcatcatcgcagtcatcccttgaaccattccaaaacccattgggccaagcataaaggcggtaccaattaaaagtgcacccgcaacaatactaaggacactcgatttccctgcccccaccaccgcaggcgtaaaatgtacggtgcaatcatcagcaagtgtcattgtaggattggtttttatctgctcttcgcttaaatagcgtttcccgattcggactttgtaatagccttttcgcaaatgttggctcaagccttgaatctggctaagtagtccgctcatcagctctttaaaggaactgacttcaagcactatcggttcgttaggctcaaatcgtttaagattgccgtaaaatttaactctgaccatttcgggtatctccaaatactgtgcgtttgttgtaaccaagcgccgtcataaggcacacgggcagacaatcgcccttcgctgtggtgtaacatcatttgattaccaaggtaaatgcctgcgtgattcgccacatcactaccaatttgcagtaacacaatatcgccaagctggggctgtgcttcaaaatctaaccgctcaaagccaaagcggagcaagttttcttcatacaagttgcctgatttaaaccattcaaactcgtactcaacatcgtcaggcaaatccaatcccgacaacatataggcatcaagtaagatattgcgacaatcttgcttgttattctcaaacggacgaccaacaagcggtgcgattgggcggaatttttgcaattttccgtcgcaaaccaaccaaaacggcaaatttaaccgcacttgacattctctgtctgcggttgatagataaggcaatcccttttctgtgtctgaatcagggtgagaatgaacaaccgccacaatctcgcccacgctttccgcccgaatccaatcatcaggtgaaatttcaaaatgattaatcggatcgacagccacattttcacaaggaaaataacgtaactcaccgcccttagaaacgacaaaaccgcaactttcgtgcggttctgagcgtttggcgtgagcaatgattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattctaaatcaggtgtttccatttttactcccaataaaaaagcccgaacatatcgggcttatagattatttttcttgtaataatgtatccaattcctttaatttaattatcgcattttggcattcttttaattgttgtattgcttgaaattgtgaaacacttgcatcaagtttataacaacttattacacgtttatcttttaatatttgaacatatcttgctaaggttttagctgagcgattttcaatactttttaatttttcaatcgcaaattgatgttcaccataactcttatccattaaatcaatcttgtgtttagagagaaattggttaagctcatgataaaagtaataataactatgtttgatgctatctctccattcaatttcgctagattgttttgacaaaatctcagctcgttcaattaattccgtatgcttaatcattatttatacgcctcacaataaagatacaagcaatctaaatctaggtgatttttttctgcaaattctgcgaataaatctgatagattagcgttacactcaactatcttttcaagatcttcgtcatctacatattgaacaaggttaacaatatgtaaccgctcatcaatttcacgaaactcagtaccaatgataaatctagaaacaatatgttgattaataagccgattgacttcaagaccgaaatctaacattaaacgtccactaccaaatactttatttaatttagtaataatatcaatattatgttttatcttacatttatctagctcagttttgataggagttaaatcgtcataagcaaaaaagttcattagccgaccttctaatgttcgaagtatttttatgtcgccatttcgagctatctgaaatgcttgtcgataacaatctaaagctaattcaaattgattaaagatttcgtaagtaaaccctaaattatagatatttaatgcgctatgattgagttcaatagatttctgacaagcaaaaattgctttactttcttgattggctaaagcataaacacttccttccatgctccacgccaaatcgggtaatattaacttcaacttctcaatgtcgctaagtaatctattaataaacataggggtgaacttcttcatataacgagcatcctcaatgcgtcgaaatagactgtccgcaatagtttgtggttgaatggctgccataaaatcctcttctgtttataatatagttcaacacaatggcgaactcatatagtttacaagtaaaacaccttgatagcaatcaagccccatactgcgtcgtacttggaaagccaccaaacggtaaaatggcgttagccccaaatctcaacttgcaaccacgcaaacagtgagagcaagcatcttttttcggatcggttgtcgggttatctttttcatcggcaaccggtccgcctgtatagccacactccgcagaacgatatggccaaatgcaagtatgagacgtaatcatcagcaacggaatacgtgcattatctgtttctgcgggtaaagccagctcaaaggtcgccacttcatcattgaggatttttagctgttcaataatgaacaaactcacactttcctgtgtcggatcggcttgtgagtttcgtccgttaggaaaatttcgtgcatcaaggaattgggcgtaaactaaacgacgtgtcactttcgccccaatcccttgcccgaaatctgcggctaatgcggtgacaatgccgtacaggtttgagattgttaaagtcggtcggttactcggcccttgaccgctaatctcaaaaccgtccgcttgaattggataggcttggtactcgttaccttgccaccaaacattctgctgaccttgatttaagccattgtgaaagcgtaatagctccccttttcgtgtttggtcgctattactgctgatatgccttaaatcaatttcccatagttcaatcaaggcattttgttccagttttggcagttcgtttgccattttttggggtagggattttggcattaaatcacctcttcaaattcgcagttaatcaacgtatgggttttacctaccgtctgcgaccattttggacacactactttaatcagtggcgtttttggtcgctccctaaattgaaaggcacttacaccaccgtgacttgcaagaaattgcaacaatccaaccgcttgtgcgtgtcgtaggttaaaactcaatgaaaatttacgttgcaatggatttaatccatcaaccattcgctgttgatagccgtcaccaaatttatttacctttctgcgaggttcgctttcgacggtgtaatttggttgtgggcaaaagggaagtatttgtaatgtcatagatcaccttataataaaatacccttagaaactctctaagggtattatctatttaacgcaccaccactacgcagatcgcgtgtttgattgcgacgatagacaccatctgcaatctgctccattaacttcacggtaattgctaaatcttgaccgtcttttttggtttctacttcggcggatgtcggtttgccgttattaatcaccgtcacagtcacattttgcgatccgccaaaatgcgtaggcgtactcggcactctcggcacaccaacaccgccaccggtcgcaaaaccacgtttgccataattgagataattcaggtaatccaacccaagacgagaagttgcctctttggtgatgacatactcgccacggtggacgatacctgctggggtgtatttgccaccatcgcctgtgtagccgccactagagaaaccaacactacggatttgtccgactaatgccataccttgagacatcacgcctgctacagctgcaaacttagatgccgcatccatttttgaccaatctgccatcgcttgacttgcagcacgggtgacattgattgtcgcctccgcaatcgcaaaagatttttgcatcgcaaacattgctttgtaagcggcagattgtttgccccctgcctgttcaatcatcgaggttaaatccccaaaagctgaacctagtgtattcaagccgtccgcatatttctgcatttcggtttgaaatttatcattcgcataacgctcaataatttgctgtttgagtttttgaaattcttcttccttaagtaactgcgtctgatgaaatgcgtcaagccgtgcgagttcttgtgcttgtcgattgactatgtcttgatttggatcataaatcgcacgcatttggtcaagcggattgaccgcactttgagctttactttgtgcgtagtcaaatttcagctgatattcagcggtttgtgcttcgccattggtaagttgccccgcttttctgagttcttcaatcgctgatagctcattctttaaatttgataacagcaatttttctggcgcatatttccctgctaattccaaccgctctttggcaaaacgctccgttatagccaatttagccgtttcatattcggtatgtgataccacaccttttttcatatgctcttcaagacgctgaaacatctgctgttcttcaagatcgatttcagttagcgttgaactgctttttttgcgaagatcatcataaaatgacagccaattatcacgagcattttcgccaccacctttatgatttgtttttagattagtttgaattgtttttgtctgtgtttcatcgttgaacataccttcaaggacttgtttaccttgtagtattttattcaatgtttcaacagatattcccaccgctttatctgctgcatttgcggcggtgatagtacctgtggcgataccaattaacacttcattgtattttgcaccttccgttccaagaagttcgtacaaccctgctaaaacataagctgatttagcttgcccttgttgctcaagttttgcaacctctaatttttgagcgagagatactgatttttcttgtaactttttaaatgcgtcatctaaatctagagtggcattttcagcttggttacctgccttgtcgatttcatttagtgcagaaggtattctggctaaaatccattctgtgttacctgcatcaacacccaacgttttaaatttttgccgaacatcatcaatatttttaccgcttgttagcatagctttagcaagggcttctaattggttttctaatacggagaaatcaatattggcgttttcttttaaaatagaaatcttatcatttaactctgatatttcttttttagcactttcaggtacaggtaaacccacataattccaactatctttcaatgcaacaatgtctgtttgtaaccgttggatttgtttatcataattggcaagatcttggatttgttgtgtaattttgagcgagagtgctgcagcacttaaaccctcataactctcttttaaacgatgatttgcccctgcagtatcgagtgctttctgtctcgcactttctgcttgctgtgtaaaataccataaagcactgccggcaatcatagctgctccgacaggtccaccaagcaatgccattacactttgtaaaccttgagacgcttttccagctaaagtatttgctgtagcaagattacgtttcgctgtcgcctctgcttctgtgagagcaataatttgagcagcttgtactttcatttgttcacgcaaggtatagcgtgtttgctctgattgtgctaactgtaattgagccgcaagacttgccatttcaacttgtgcggctgttcgcatagccgttgcttttgcaagaatagattgagcttctttggtatgagctaatgtgttttttgcactattaatgcccgtttgtaaaagtgcggtcgaatatttgccaatttgcccaatcgcaagtgcagcggcaaaagtgcctgcaacagtaatcagatcttcgagattagtggcaacaaattcaacaccttcagccagtttttgtgttacaccaatagctgaatctgtttcaccgacaaacttaatcattgatgtttcaaggttagtaaatgacatcgaaagcgttttaacacgcttttcaaaatcaccatccacctgagattttgcatttttgagtgctttaatgacttttgatatggataattcgccgtttttacccatttcttttaacgcaccaacgctgacaccaagaccatccgcaatcgcttgtgcaagtccgggcgtctgttccattacagaatttagctcggcaccacgcaattcaccactcgccattgcttgcccgaactgcatcaatgccgcttctgccgacgcagaacttgcacctgacatagccactgcttttgatacggtttcggttaattctgccacttcggcttggctgatcttcaatgtatcggcatttttcgcaaagcgttgatacacttcagctgttgcacttacagcttgatttgttcgcaatgaaatatcaaaaacggtaccagttgcagctgccatttccgcttgaccatctgtaactaggcgtatgcggttttgtaattcggtgtaacgatccatcataacaaccgtttgtttggcaaaatcttgcaagcgccccaaattatcaagacggaaactccagtttgtcgttgaattaatattgttagccgctttttcaatattgtttaaatattgcgtggttcgctctgaaaactgccgtgcttttgcctgtgcccgagataaatttacctcaaattgcttggcaaatttctgggtctgttgttcagactttcccagccctttttgaaattgaatcgtttctaaatccaatcggatatacaagttaccaagagacgacatattttctccaataaaaaaagcccgcatattgcgagctttctatctatttaaattactacttaataataacgtatttaacgtcgttttctttttgcatttgttgctggatttctttttcccattttttattgaaaaaatacatcgcaactttgacaatacttaagaaaacgagatatgccaacacagcacccagtataatcttccaagttatgccggtaattattccgcctaaggtcaaaagaattaaagcgggaatgacaaagaataaaacaattactgaagtaaatgctctacctaaccacaggataagatcaatttcttttttaaacataccccctccttacttttctcttactgtacaaaattattgcatttaaagcaataaaaaatagtcacattttgactggtttaacagattatcggcttgctaaataagcctctacaccgtcatcatcgccacttttagtgacattttatttctcccataaaaaaagccacccttaaaggtggcttaaaatttccatttacttagtttatttattaatttgtttccattttctcttctcttctttggctaatagatagtcacaaaacttgatcaacccatttaataatccccaaagagagaaaataatcgcaacaccacttaacatacacaaaataaacataggtaaatcttgttcagctgcatttattgaaaaaatcaacatggaaatggcaaaacaagctactataaataacagaaacatcttaaataaagagcttattgtataatttaccgtgcgagcctctcccacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatgggtgtttacacagaatttgggatagggtctaccgtgctataaatagctttcatattcaacctcccatattgccatcaatctattcaaaacataaagcactaagcggtcattttcaatgcgttatatttaacgaaaattacccaaataattcggaatgtgatcctaaacgtaccaagcgaagtaaattattttcaaccgcataaatcaaaacaagatcaggtttgatatggcaatctctaaaaccttgtaattctccttgtaatgggtgatctttatatttctccgccaaaggtaactgatgcattaaacaatacatcacttctatatattcagcactagacattaactcagaagcaatctttttaaaatctcttttataagcatttgttggagaaagttgtaacattatttactccgctaacattgctttatgaaacgcttccaaagattcatatacttcatttttacctgatttagcttcctgcattgccaacttagtttcaaggtttggttgataattcaaacttaacggaattgttttagtatatgcaatttcagtgagaagcatattaaacacttgtgatggagtcattccataactttttatcacttcaaaagccgtatttttaacttctgtgtttgttctaaaactgaaagcatcattaatggtcgccattttattgcccccctgtatttctatgtaatacatttattttaagttgaattacaacgaaatacaagggatttatctgttagccaaatacgccgccacaccgccgtcatcatcttccgcttcttctgccttttgataaaagggcataaaatccgataatttcgggctgtcgccttttggatctcggttgatcatcgctaataaatgcgatatttgagcggtgcggtaatcttcccgccaaagcccgaaaggttgttcttggtaaaataattcatactccgccaagtgtctttcgggcattgcttcaatttcaacaagggttttgcctaacgccagcgataaatttaactggaagcgtcggcggtcggtgagttttttgggtcacctaaaccattgttgaaatcaattaagacttggttatctaattttgcaatggcattcaaatcatcgacattaaacgggtcaaacagcaattcaccattctcatcacataggcgtacagcaatcgactgcggtaaacggtattttgcaccgaactcacttagagctgtcgcaaagttctcatcctcttccgcaggcaattcatagccttcgagctcagcttgctttttcagccatacgttgatgccgtaaagatggttgttcatatccccaacggttaaatcacgcacatagtaggtcgtgcctttaatctcaatcgggttcaatttgggggtttgggataatagggtttcacgtaaagtcataaggtttccttttattgaaataaaaaaccgcctgtattactacaagcggtcagttatcgccaattttttacaactatcctgttagtggcaaatgataatcgcgtttggtatgcttaatggttgcaccgctttcaaacttacctttcacttcgcctgagtagttgttaccagattgaacaaagccagtgccgtacattgtgccttgattgttggtgaaaatcagtttgtacggaaagctttctttggcaaaaaacttcttacgcaaaagtgattgcattgccgttgaaggtttcgcatagaacgttaatttggttgaaccaaattcaatttcaccaggttcagtaaccgtcccttcatcgcacattgtggtaacatcttcttccgttaaggtatcttctgaacgttcaatgtttttgatcgcacagaaattatctgaccactttactcgagcgactttagcttgtttaaagtctgtcggttgatcttgagcagtccaatctacctcatcagctaaggtgataaccccaggtgagccgttatcgacggatttaatcggataagtgccgtctaaacttcctaaacccgtgatcgtaatcgcatcaccagccttgaaaccgtttgaggcaacagtgatagtcgcgttcggtttaacgttacacgctgtgatattcttttgctcttcgacacctgtgccaatataaaacttcgtgccttggaatttggtggtttttcccgccataattacactccttctcgttgatattcaatgttaaaaataaggtttgcaacgtaccaagtccgctgttgctggtcttgttcgtagctgtattgagatagctcaaggttgtcgatatgttcaaaccctgtgcctgattgtgtggtttgcatcacctcggcaatttgttgggcgatctcatctagttcactttcgccattgtcgatagactttatataaatggcgatattgagctgtgcttgccactgctcatcgcaatttgtaatgccgtcgcagtaagcctcatctaaaaagacggctatcgctttttgctcttcgtcaatgtcaataaacgttggtctgccgttgtagtaatgttctacatcgctaatctgttgctccaacaattcgacgacttcagagcggatttgagtgtggatacgcattattttctcctaaagacaaaggtcagttggttgatcagctcttgtttcacttgctcaggatattgagacaactcctgattaaacgcttcagtaagcggtgtagataacgggactttcgctacatcaataccgtagcgttgtttaccttggcgaaacataatatgcgtacgtccgttttttaaggtttgtttaaaacctctagcaacagaatgacgaccaacacgcaacacacccaggcttgcaacaatccgattacgtttcccttccaatacccgaattaatggcaaatgagtgcggtttactcggataatggcttggggattttgtttggtcggatctttggtcattttggcacgcccacgcaccgtcttgacgggtacgccaatctgttgagccacagactttgtggcttttcgcattgcttgcttacccactgttttaattgctttcgctgttgcagtcggtattttttgtctgacaagctgttgaatatttgcctcaagttcttttaatcccgttattttgacacccatcgcttactccaactgtaatacaatcatctgatcgacatagtgataagatttgacgaggtattttttctcgccttgtaccaccttatgatctaaccgtggtttatagcctgatgagcgaaatagcgtgagtgtgcgtaatgtgccgtttaaggcttgttggtccaccgaaacgtgaagcccctccataatatgaggggcttcgtcataggtagctggatatggcttgccgttaatcagccactccgacatcattacacgctcaatcacgctgtccgctttggcgaaggcttgttcaaacaaactaggcattgagtttcaccgtcactactgccgttgaactcggcgagtctgaccacgcaataccgatatatttatgtgagcctgctgttttggtggcttcttttgcagaagtgtcccagtaaagcttgtcaccttgagcaatcgcttcatcgctttttgctttcacttgccataccccgatcacagacaatgccccgatctcatctttcgcaatatctgcaacagcaatgccagctaaatcacctgtcacgactaattcaccgcctttgattgcggtttttgctttaattttgatggcttcgcccatctcgataaaatttgttgccataaaaagctcctacaaagtttaaaattgattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaattgaatttgccctacaagttgttggttaagccgttgcttttagtaagccacgataatcaatgacattgacacctgcatcaatacgcactttggttgcaataccgtcggtgttaaagccttccatttggtcaatgaatggtgtttctacgccgtcaaggtaggatacttcgatcgcttctttattaatgagataccaatctgtcgcgctgaccgcttgtaagcgttgtgatttcgcaatcggtacaatgttttgcaatggattgataatgcctgagtttgcctctgcaccttcaacagagcttgagcctaagatttgttttgctctggtatgaagtgctgttggaacaagcaagtaatccggttcaatcaatagctgagttttaccgtcaaaagatttgtgagcgttcatcatttggatcgctttgtctaacgtatttaaaccaaatgcactattatccagtaagttaccgcgagtcttatcaaacaacgctttaccgtccgctaacttaccattgcccgtaatggtcgcaaaaatcaaattagcaatggttgcttttgctgcttgacctaatttgtatgggattttggtgagcattcccatatcgtcattgataatcgcctgacgagtaatgctgaacgctttaccataagtcgctaacgcaatttgggtttgcgtgtcggttaaagtagcgtaggtgtattctgctccttcaggtaataaatcaagctgatcgaagctacccattcccacacgatgagcagggcggaagtcggttaatgtgccttttgttgtgaacttgtcgaaatcttcaatgtgttcttgccagcctttaataatcgatttatgtgcgacatctaacaaaattgagccgaagtcgctacttgaatgagtaaaggcttgtccgacaatttgcattgcgttcataccacttaatccaacgccacgatctaccaaagacgcacgagccatttcacgtaaggtcattcctgcgtatggattgtctttttccgctttctcaccgccaccacgatgaattaacgccgctttcatactgtcaccgacgatattaccgtttgaaacgtgaatatgagtagtagcaagcggttgagtgtctttacctaattcagccaacaaacgatctttagcttgttcagcactcattgttaagtcacctaaacactctgccattaatccatcaaaacgcccgccaaagttagcaaatgttgctttaattttggcattgcgttctgcaagtgtcgctaacggatcggcttgtggaatttgtgcttttggttgctccgcctgtgcttttggctcttctttggtaagagctggctcagaaactaccgcttgcggttctactgttgtttttgcttgggcttttggctcaagtaaggtttttaatgcatttggcatagatttgaactccttcattcgttgagaggtaattgatgccattgccttaataggctcggcgagtttgtctgcgaaaccttgctccacacactcttcggctgtgagccacgtttcttcttttagcatttctgctaattcttcaggggatttccccgttttttccgcatacgcaggaataagggtattttcgattttgtcgagaagatcggcatatttacgcatatcttccgcatcaccgccttgaataccccaaggtttgtgaatcatcatcattgcatttttaggcataatcactggatcgcctaacattgcaataactgaagccatagaagcagcaagaccgtcaatatagacggtcttgctggctgggtgattttttaataggttgtaaatggcgatgccgtcaaacacactcccccctggggaatgaatatgtaaatcaatgtgcttgaggtcacctagatttttgagatctttcgcaaattgttgtgcggaaatcccccaaccgccgatttcgtccataatggaaatctcggctttctcttttgatttggctttgattgagtaccaattcatttttttcctccaataaaaaacccgactatttatcgtcgggttcttctgtcttttccgttacaacattttcagtgtgaacttgtgtattcgttaaatcagtgtcgaacttaagaccatatttgcggttttcttccacttccacaattcgtcggcgtttcacttcagcaggattattaccactggctcggattgcttcgctttcagtagatatcccaccaacaattcgacgtcgccacgcttccgtttctttcacaggatcaatccacggcatcacagggcctgaatacacggcgttataaacactgtttggatcaatatcagggctgatttcaatttcccctgatgctatcgccattctgagccattctcggtaaatcgggcgtgatatactggcaacgaaatgatcttgcagtaccgcatagccttcaaaactttctactagctcttgacgttggcttgagtaagtgccgttgtagtctcttgcaatactagaatagcttgagcgtgtacctgcagccgtagcccgaagttgcccattgcgaaaactctctaagttagtgtttggacgattagaattaatcagcccaatatcttctcctggttttaagtcgtccacgacttgtcctggtgcaatgtcaaaataacgattttctttactgacatcatcaggatcgaacaacgcagggtcgccttttttgatgtacatcgttaaggcagcagcaattcgtgcggcgacacgttcgctttcttcataatctttcaaatcagcaaggcgaacaatgacaccgtgaaaaagtgaaacaccccgtaattgatgtatccgtttcactaatgcaagatgaagcatattttccgcaggaacggttttcactcgcccgtaagtgcggttatcttcttgtggattataaaaatagacttgataacccgttggttttcgccacgcattgagataaatcccttgtactaaattctgatcttgttcattgctattcatcgggacaaaatcaggttctaaggcttctaaagaaaaaggaatagacgtagcgtgtgttaagccagacaccttacctaacacaaggtgaacaaaaacttcaccatctcgcaaccaagtccgtagtaacattcgctcaagttgtggacgagtgaaacgccctgtcacttcaggtcttatagaccattctgcccatttgcgacgaatatcatttgctagggcttcattcacattgccagctaaatcaaggggctgtggttcaacataaatacctttcgaaccaattacacgttcttccagtttatccaaaatgccgatcacaatatcgtgattttggtctaatgctcttgcttgctcacgcagactgaccgcactttgtctaactgcagtatttgcaccttgattttctcgaatggctttatgcaatcgactgggtttcgctgcttcatacgcattaagtaccagtcggtgttttgctctttctgctgcccatttgggtgagattttagcaatggttttttcaaataaattcatttaaaacctcgccaatttaaaacgtccgccagcattttgatgtgcttgttggcgttgtactttgcttaaacgttcttcccaatactcccgacctttacggatttccgcaaggttttcacgggtgacattacgtccattaaaggtgatacttttcccctctaacaccgctaattcggcttcgacgtatttgtcgatcatctgttggatttggtctaatcgcatttttcacctatttatgtttataaccagccaccacttttcctttctccaccatttaaccaacgttgctgtgtcgtcgattttggcttttcaggcagcggtgttgatttttcttcaacgctgaccgcttgtgcctgttcgttgtgtggggcttcaaggttaataatatttggatttagttcaggcaatcttgcccattcgggtatgttgcgttcatctccccatttgatccgctcgtaaccgcgtaaaatcgcaatagcgtgagcataacaaaataagtctaaggcttcgttattgcctttacctggtttgaaccatttgccgtctgccccacgctcttcataaactaattcatcaaaaaaccattgcccgatccagtctgggaagtgaatgtaattcgaaccttgactggttttcgcaagtgcattgctgatacggtctttgagttggtctgtttggagtaaatataggggaacatctcctcgagctgatgagtgtcggtcgcttcgtgtagtgttgtcaggataactttttgtgatcagcttttgccgtttggtgctgtcgcccttaaccaaatagaccctttttgctaatccatctctgcgacattttcgccaaaatttataagcattgtcagttacgccatcttcaccaccactatccaccgccattgctaaaatcggcattaggcggttgtcgtgagttgataatggatactgtttttcgagtacgtcgctgattagaatatgccaatcatcaggtaaacgtggatcgattttttcaacaacgccgtcttcatcaggtaaggtgtgcgagatgttgtagcggtcaatcagccagcgttcgccattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgttcgccattttcaccataaccgacaatttgcaccacaaagcgacggtttcgtccgccttgtacatccaccgcagcaattaagaagcgacactgtggtggtacggttttctctttgagttcttctctgcgttccatgagctcatctgctcggcgttgttccaacgcagaacgggggaaatagggcaatccccagtcagtgttgataaccgcttttaaggtttcttcgctacctgttaaatcatattcttgttccgcagtaagtagtttataagttagctgtgcccacgtttgataagcagccgcaggaccttctaaccaaaaggaagcaatgcgtgatttgcgtccttctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatctgaccgcttgtgtcaattttttgcccttctttaagccatacaccattgatattcagctctcgtttcatttcgggcggaattttatgtaagcagtggggacattgtagtcgtgccttttcacttgcagtcacaaaatcaggttcgtccctgaaatccaccatatttgccattgatggttcgaaatattccgaacattcggggcattgccagtagaaccgtctgcggtcgcctcggttgtataagctcaaaatccctgttgttggtggtgcttcgtggctacttttcggaacgtgtttaatatcaacaatatctttaccaggagagctttcaaccagtgtcattccggcagacataaaggtggttgtacgcttagacgctagggaaaaaccgtccccttcgccgtcaatatcatcgggccagcggtcgtaatcggttagtgcaacatatttgtagtcagaagatgacagtacgttaattgacggccaaccgattttgagcaagttgcccgctctgaaatatttgtcgtggacgttgttgtcatttttacgggggctgagccgtttggctatttcaggcgaacagcggaaagtgcggtctaatcttttgcgactgtgttcgctggctttttcttgagtgagttgcaccagtaagaagtcggaagggtcgcaaatgatagaatatgtgatccagccgtcaattaaacctatggttttccctgttcgagcaggtccgacaaagacaacagcgtcatattctcgggagtttaggcagttcattggttcaagcatataagcggctgtatttttatcccacttgaccgagtttcccccaccaaccggcactcgcatatattctgcaacagcttctgatactttcattcggcgtggtgctttaatggcatttgctatatcacagcggatttcttttgcactggcaaacattattcatcctcgctcgtttgttgaatgtgtagtgccatttgatctcgaatgtcatcaatcacttgttgtactcgaatgagatctttaggttgtaacccacaatctcgctctaaaatatcggggagagtttcaagagtttggactacggctttggctaaaatactcatttcttgcgatacttcaaaagctggaattagctctcgagtttctcgttcatacttcaagcgttcgttttcagcttgccaaaaagcacggcgatcgttaggacttaaactatcaacatctgccgacatcttctcggttaaaccagtcaaaatgagatcgcgtaaggaatagagttttagcttgctattactgcccaaagatggcgttaatccagcaactcgttgagatactgtctgcctatgtaatcccgtgacttcggcgatctgatttatatttaattttagttcgtgtaaattttccatttcgctaaaaccttcaaaccgcttaaaacaaaaaattgcacccaaagtgcgaaattaaaatgaaagatgatgatgcctagaacctcaaaaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacatcacttgcgtattttctcggggatttatctaacaaccccaaaaccatacgcaaattatgtggcatttgatttacataaaataaaagagcgatcatctgaccgctctctatcgtgacacaaacactaatcagctatttaaacccttgcttagttcgtgcttgccactctctaatgctatcaatctgacccgcacataagtcacgttctcccatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgtgcaaccgcttaagctcatcgacaacaggacgaggcaaagcagtaacgctacacggctctttctgtaaaatagctttaatctgttcattactctgctccacctgctttcgcagtttatttgcaacactttgctgatattccaccgcttgtcgctcttgttgcagttgcattgtcagcttatggtttgcttcttgctgttgctcaatagtttgggcttgtgtttggttctcggctttcaagctatctatcctctgtgactgaccccatagccacgcacacaagcccaaaatcaatgccattaagattttattaacccagctaaacataacgccttctctttctcacgacggatttctaaaccacgtaacttcttgccacctgaataaacccatttaggcaactcattacaggcaccaacataatcgcctgatttgattttacgaaagaacgtcgatttactcacggtgccacacccagcattaaacgtcagcgaagtagcaacatcaaacaccgattgcggaatatcaccaccatttgcgtaacggttcacgcatttttccgcatttttaatatcgaccaaccaacgctctgcaatctctttgtccgtgtaaacttttctttcaatcttaccgcttgacgcttccgttgaaccaataccaacagtaagcacatttgcaggacacaaataaggctcacgtttacaaccttctgcatcgccgataatttcaagcccttgcttacttgtacgaaattgaccgtgaaaatctgtattcaacaccgcaataatggcactgacaaaacaaaccccaccgccaactttacctagtgtttttagcttgctcattacttaacctctctgcccttacccgataaatctgcattctgatttgatgagcttcttcggctcgctcacgttcacgacgcttcgccttaccttcgtcacagcgttgatacaagttcgcacacgccgtcacaataccaatcgcaagacttaaaatcattaaattctgttgctcactcagccacgcaataatcccactaaatccagaccaaatatacgtctgtgttcccatatctctcataacatttttcataccttagccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggctttcaccgctcaactaaaaataggaactaagacgatgaaaacctatcaaatcatcatcttcttaattctgattgcgttaagctcatcagcttactaatcagataaagtcctagcggtggttgcccccactgctaggcagttcctaaactatacaaccaacgttttaaaaaatcaagtaggtgaccatggcaaattcaatgactgaacattctcgtaaacttcgttctaaaactgcgaacgaatataacaaactgtgcgtatggaaacgcctgttgcggacgaatttgtggcaatacttgctgaaatcggcggcaagaaagccgaagccattaaaaaactttgtgaaatttatcggcaacatcaggcgtagcaatacgcctaaaacttcagtctaatcaaccccgaaccaaataccgccccttccataaaatctcgtgcggtgcgtaaacggttatcaaatgtagtcggtgaaatctgcatctcaagacaaatattcttcttatcctgtccttgtaaaaacaccgccattagcacctgataggcttccaaattcaaatcgtgtaatgtcatcacagcttcatctagcttaagataatgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactaatcactaaccccaactcatcatcacacatctcccgaacaggttcagaaatacggctaggttcggcttgtaacatcaatcttgccaacatattcatacggctttcaaaatccaacccactaaatgcccactccccccaaaggtttaacaagttctcaatccacacttgctttggttcttccaacagtttatccgccacgcttcaactccttaatcttcgccctatacgttttaataatttccttgcaatcctcaaccgaccacttcacaggagggtgatagctttccaatgcttctactcgctctgccccgattttacgcacaaggttgatgcgatattctgtaatgtttccgctcaaatgattgttacaagcactgcattgtttatgaacattgtcctcattaaatctcagctctggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgaaatacaaggctcatctttatctcgtaaacgaatgtattcattaaaaacagcctgagcgtctttaagccactcagaacgagattttaagcgttctctcgttgctttaatctttgccctttcttctcgatttcgcttttctatggctttttgacgtgctttctcttgggctattttggcaagtttcacaccacattcagcactacaccattttctaaagctatccgcagacttaaactcaccaccacagcatttgcatttacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagacagaaattcgggttacagaacgaaatggcgaagactatatcagcctaacagatatgtgcaaagcctttggtgatggtgatcaactgataaaaaactggctacaaaacaaaaacaccattgaatttttgcaagtttgggaagagattaacaacccaaattttaatttggtggaattacaccaaattaaaaataatatcggcttaaaccgctttgtaatgtctgtcaaaaagtggtcagcaacaaatgctatcggcttaatcgctaaaacggggcgttatggcagcggtacttatgctcataaggatattgcccttgaatttggctcttggctcagcccagagtttaaactctatctcatcaaagagttccaacgtctcaaacaaaaagaagcccaagaaaataaaacggaatggaatgttaaacgtattctaagcaaagctaattaccgcattcataccgatgctattcaagcacatcttattcccagattactgaacagcacacaaccaatatttgtgtattctgcggaagccgatattctaaaccaagctatgttcggtttaaccgccaaacaatggcgtgagcaaaatccgacattaaaaggcaacattcgagattatgccagcgttgagcaacttacggtattagccgctctagaaagccaaaatgcactactcatagagcaaggtgtctcacaaaaagagcgacttactattttaaaccgcctggccattcaacaaatgcaatccttattaaaatcaaaatcacttgaaccattaaaagataagccgttgttgattgaagatagagaatagttgagcataggagttatttgtaacggatccaccgtaatttgttataaagtaaaacttgacttttaaaaataaagccttatattagtcgtcagaagcagaggattgcaagattctttgttgctgattccggggcccagtctttatgattgggcttccgtgtatttaagttatggaaagtatatgcatccctctcgaacttatattgtttatcttgatgaatttggtcacgttggtccttatgtttccgtagatcacccaacacataaaactcaccctgtttttggattgggtgggttcgtcttgcctattgaagaggttcgtccattctcttctttctttttcaatcttaagcaatacttgtttgaaaattatgatattcctcaagcaagaaaagaagccaaagaacaaggtcaagtatttaaactttcgacgtgggaaaagaaaggatccaagcagtactctgtagcaaatctacaaaggtatacaattcacatcacacgctctaccaatcgcattataaatcaaataaccgaacgtggaggtttcctattttatgttggtgaagccaagcaaaaagatgtagataaacacgatgctcaacgggtttatttatctagtttaaaagagattatcaaacgactagatgatgaatttaaaaaccaagaagatcaatttctgatctttatggatgatagtgaatcaagtgcaagtattgtaaaaaatgcaatctatgaaatgcatcaaaatagcaaatttcagctaatcgaagcaccagtacaagtagacagtaagttatatcaaacaattcaatgtgctgattggctatgcgctatttatggtaaactttcattttatgaaatagagccagagtccaaacctgactacgaaattttcaagcgttattttggtgatcgcattgctaaagcgcaaaaacgcagtaatgtgagaaacaatttaccaaaaaaagcctctgaaaaatcactcaaaaagctttgtgacaaatttaataaccacaactgaccgcccaccgtggcggttttcttttatctaagtatgaaccgcttgttttacttcaaaggtaagatttaaagcacgcatgactttaagcaccgtagaaaatgtcggattacctttacccgaaaaagccttatataacccctcacggcttacaccagcttctcttgcgatctgactcatattacgagccttcgcaatatcgcctaaagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcggataaaatcaaatctacatcatcttcttttagcacctcatttaagtaaagctgaatttcctcttcacttcttaaatgttccgccatatcaaaatcttgtagttctaccatattaaactcctaattctttgctagaatatattccaaataacttagtgaaaatacaatctatgccattatacgaaaatgcaaaagcacttattagacaaaatctaaccgaaataagccaaggaaagaaagcgaaattacaagtaataggctcattcacagataaacaatttcttgatataaatcaacatagaaaaaaggcagaattgccaccacttgaatgtaatgaaattgtctatattggtcgccatcattatcaaagccgaagcaaagacggttacaatattaacgatatggtaaagcaagcagaaagcgcattatccgttcattcttgccttgtaccatcaaaccgagctaccgccctagaaaacccacaccaacgtcacgatggctacggtaatttagtgaatgatcgtgctattttagagttaacatcaaagaaaccccgtgctgagttgttttctgtcattcctaaaggcgacagcataaaacccaatgatgaccaataaacaaaaaccccgaactcatcagctcggggtttatattaagtggtcttgggtaacttagatttccaacgcccccacttaataaaatcgaccttgggtaacttagatttccaacgccttcgatttgtttaaattataaatctaacaattcattgcgtcaaatttttccgaaatattcctttattctcactaatttttccccctttctcatatctcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggatcgcagtcctgaaagaataagtggcggtaataatgatagtcgccaaaagcgactttttttatagccaaaatctagtcagattaaaggtacttgcaaattgcaagacccttaaaacttcaaaagggtgttccaaattgacactccctttgaaaagttgtcaatgatggactaggtaagggggcgaaagcccgctggaagtttaaccgcttattcaccagtactgcgaaccttgcctagttcatcaccagtaatcgcagttgctcgtgatgattgaattaaatttcaattagagaataagcgtatgacaactttaacatttcaaaacaccgcaatgacggtgatcagccaaaaaaaataaaactttctttacatcatttgatcttggaaaggcattaggctataaaaatccatcagcggatattccaaacctttacaaccgcaacgcagacgaatttactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaaaagatggaaaatacaacaaaaatgttatttgacaaaaaatctgtcgctacactgcttgatgtcagtgtaccaacaattaacagaagaatgaaaaatgacaaacatttcccaaagccacttctgatcggaggtaaaaatttttggtctaatgaacaaataaaccactatattgatacaattcagagtgaatgcacctcaactgcataaccctttcccctcagctgcttgctcaacaaaattcccccaccattgcatatattcagctcgttgagttaagtattttgctttattgtatgtacctcgtacactggagtattcaaaatgagccaagcacacctcaataatttcggaattaaactcagcctcattcattgctgtgctaaataccgatcttagtccgtgagcagtcaatacattgcgataacccattctttgcagtgccttattaggcgtttctttactaattggctggtgcggatttttacgactagggaaaacaaaacgactgtgatagcgatttaatttttgtaaaagctgtaaaattttaatcgcttgagtagatagcggaagcacaaaatcctgaactttcccttgtcgccccttcattttctcttttggaatatccaaaatcttttcctcaaaattcacttcagaccattcaagttgtgtaatagctcctgctctccctgctgttaagatcaacaattctaatgcacaacgagtttcaatttctagcgtactattttgtaaatcttcaaacagtttgcctaataattcaggacgaatagtaggattattttctacgacgggtttcaaaaaaacctttccaatgtctgctgttgggttatatttaatagcccctcgatttactgcataaatcataatctggtttaaatacccgatcatacgatgcaaagtatctagcttcctttctcgttctaatggttttagtttttcaatcgcaattggtgctgagatgtccgcaataggatagtgaccaagcaatttcaacaaatgccgatttagtcgcttttcaatatcgttgtaggtcacaacctttaacctgcccgtatctacctcatttttttcaataccaaccactcagtagccatcgaggatagagtgagaacttggctttctaaagccgctttttcttgctgtaggcgataatctaacggatcgacattttttgccaataaagagcgataaagatcacgaatttcacgagcttctttgagtgaaactgacggaaaagcccctaaactaattaatgttcgtttcttggtaaaaggtttataatattggaaacgccaaattttagcccctgtagctctaacaagtaggaacaaacctaaaccgtcagaaagtgaatattctttctctttaggctttgcattattacattcagtaacgcttaaaggcttaactgtaactgccatatatatctcatttggtattaccaaaatcattttggtattaagaaaaatgcgtcatttttcttaattttggtattacataatgaaaaaatactaaaacataataccagatataataccaaaattgtgatataggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccccacataggatgatatagtttgatatggattgatacagcagaaatgtaaaaagccttgttttacaaggcttttatatatcatttgatatggattgatacgaaatgatttagaaatatggtgcgactagctggactcgaaccagtgacccccaccatgtcaaggtggtgctctaaccaactgagctatagtcgcataaaaacgaggtgtattctaaagaaaaagcgaaaacaacgcaatagtgtaggaaaccaaccgcttgtttttaatccaaatttaagcgtttttgtgtaaaaatatgtttatcttcccaacgtaacatcgtcaaatgattaccccaaacacagcctgtatccaacgcataaatcgtatctggagtttgataaccaattaaactcgcccaatgcccaaaaataatcggttgctggcgataaaacggattatctagttcaaaccaaggttttaaggcttctggagcctcttcgactggtaatttacaatcaaaatccaaccgcttatccgcataacaaaaacgcatacgcgtaaacacatttaatgcataacgccaacgctcaatgccttgcaaatccgcacgccactggtctggtgaattgccatacatctgggcaagaaaatctgcaaattgctcaccttgtaacaccgcttccacttcccttgcacaagctaaagtggtcgctaaatcccattctgggcttactcctgcgtggactaacaaaaattgatgaacagggtgttgtgccacaagcggtcgagagcgtaaccaattttgcaattccaaacgatcttccgcctcaaaaatcgcatcaaccttatctttaggcttcaccgctttaattccctgcagtgtcgaaagtaaatgcacatcgtgattacccaacaccacagttgccctctcccccaaagccttcacataacgcaaacaagccaacgagttctcgccacgagcaaccaaatcacccgttagccaaagttcatcatactgcggatcaaaattagcttgctcaagcaacaactgaaattcatcaaaacagccgtgcaaatctcccacgatataggttgccatcgttcttctctactctacgctctgcaaaatacgatctgcaaatttcccgatactcaccgcaaaattattcgacttattccaatctaaaatcgtacggaaattattcgacaccaagaacgctcgccccacctctttatcaggacgaaccaaccacaacttcgccgaactcaacgcattcagctttgatgtttcttgagccgttggataagcaagataaacaccccacgcttgccactcggcaaggcttttcgccttattcaactcaatccctgaaaaagagagatcgataggctgagccaacttaacctcgaccccccacggcaaatgcttatcccaaccgaccgttgccagataattcgcaatagaagcaaaggcatcatactgatttttccaaatatccttacgcccatcattatcgccatctgccgcatagttcaaataagaggttggcataaactgcgtctgccccatagccccagcccacgagcctttcatctcagctcgcactaaggttccctgttgcaacatcttcattgcattgacaaattcttgagtaaacaacttctctcggcgaccatcaaatgccaatgttgccaacacagacaacacatcaaaattgccctgataacgcccgaagctactttccataccccataacgccatcaaatactctttttgcaccccatatttctggcttgctttagttaattgaggctgatattgccaccaacgttgtgccgctgtatccacttttgcttgggttaaggtcttattcaaataattcgttaccccatttggatttggttgtggcggaggcaaattaggatcacgacgacgattagcttgttgctgatctaactcaacggcacgaggcacatactgaatattgaacgttgtatttagcacctctgcagaaacaccctcattcgccgcttttttctttaaaaaactcacataatcatcaaaatgagctaaagaacgagcattaggatacttagcctccaacgccaccttaggatactcttgctcagaattagcacaccctgccaacaccaagcacgccattgatatggttaaataggatctctttatcatcttactttatctattgaccattctacttggtctaatcacattatccgcagtaatttcagcaatacctaaaaacaacttttctgctgaaaacaaacgcacctgtccataaatcccctgcggattatcaaatttcacacgttgcccaaaacccactgcttttgtctgttcatcagttaaatccaaatgaggtaaacgggccaccgcactatccatcggcaacaacaactgatctaactcaacaagcggctgattttccgctaaattttgcaaggcttccaagctcatcatcttctcaacaggataatcagcaaccgccaaacgacgcaacatcgtaacgtgagcgccacaacccaacgcctcacccaaatcatcaaccaacgtccgaatataagttcccttagaacaatgtacttccaatgtcaaataaggggcttgatactcaacaaataacagctcaaaaatcgtaatcgggcgagcctcacgctccacagtaatgcctgctctcgcatattcataaaggggtttaccattatgctttaaggcagaaaacatcgttggcacttgcaaaatgtcaccacgaaatgcctcaagtgccgccaaaatatctgcaatttcgaccttcactttacgcttctgcaccacttgcccatcagcatcagaagtatccgtccgctcccccaattttgcgatcacccgataacgcttatccgcctctaacaaaaactgagaaaacttagtcgcttcacctagacaaatcggcaacatacccgtagcaagcggatctaacgcccccgtatgccctgctttattcgcattaaacaggcgttttaccttctgcataatgtcgttagaactcacgccttgcgacttatccaataagaaaacaccgtgaacatcacgtccttttttctttggtctgcccattgttactcttcttcaacgtagcgttcttgatctttacggatcacatttgtcacaaggtttgacatacgcatcccttccactaaggattgatcgtaaacgaaacgaagttcaggcacgatgcgtaaacgcatcgccttacccactaaggtacgaatatagccagatgctttatttaagccttctaagccacgttctaccgcactttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgctatcaaataggaaagtgacaaacactttggcataggctaaatcacgactgatttcgacatcagatactgttaccatgccaatacgtgggtctttcacttcacgttgtaaaataattgcgatctctttttgtagctcttgtgctacacgatctgctcttgaaaactctcttgccattgttttttctcttaaataaataatggggcgtaagatacgcccctaaattgtctgtcttattgcttgtaacagcaatataattgcctgtgataatagtccaaaaaggcttatttcacaagcaaatgatatacaagcggctacttttgcctgattttttgcaaaaagtgactaaaactgatacttcattcctacactcacgttttgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacactcacgttttgccatttttccccacctttttggcgagcaatcgcatattccccgaaaagatgaagagctttgctaatttgataattcaatcccaacttcgccatagtggcatattttgcaggtgaaataccctgtaattcaatttcactttccgcaccgatatagcgagcattaaagccaaacgcattttctgcttttggggtcatacggtgagataaggtcgtatttaagcgtaaatctccccatttcatggtggcacgtaaccctagcaaataactatttaagttatattgagtacgatttgcttgaataccaaaatttttcccttcgtcaaaggctttttgataaacagaatcaaattggtatccgataaacggacttatttcaccttgttcaaatttaatacgatgtcctaattccgtatagaaatgataaagctttgatttaacctctgtttcgacacggcgtgtttcatttggcattaaaattgaacgcttaatcttgtttttcgcatttgccattccaagctgtgctagcaaatagttattgtctaataataagtgtcatatttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgaccaacgtggatcatcccactctgccttagcaggaataacgacagttttcatattcgctgctttgcctgaaatcatacctaatacagaatcttcaacggcaaagcattcattgactgtggcactgagttataccactccatagaaaaaaaacatataaacagaattgagcatttttagagccaagataaacgtcatttactcaagtttaacagtatttccaaagtacatttggaattgtatttgaaggaatgcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcgttttaatcacagtaacttaaagctcaaatttccatttaaacataattagttaaaggcggtttaagttagttatctagcccctatttattatagttaaaagcccctttatccgctgataaaaggggcttggaactacttgaaatttattcctaaactatctcgtagtaatctgactttaaattaaaaaaactaacagatacaaagtctgagaaatagtgtttaactacatggggttaaatacgtttaaagtctaagtgaacaagttttggtttagttgggtgacgttgaatcgcttgtacttttacttgctcttctttacccgcaacaacgatagttaacacttcgttgtagaacgcatcgtgtacttgtgcgttgtttactttatcgtggtctaaaatgattgatactgcttctgctttaccaccgtagatgattgcaggaacttgaccattgtgacgcaggcggcggctcgcacccttaccttgcgccgaacgaacttcagcttcaaatttgaatgacataattaaattctcataaataaaaagggaacctaaggttccattgatacaaaaatagcaggcgacccagctatttccctaaatttgacggttaaaaaaccgagtgcgtattctaatgaaaatttaagaaaaatcaaacattacttcgctgtttctactttttcaacagtatagttcagtaagtaagcgcaatttttcgtaatttggtaagaaacttcacaaaagtattgtaaaatgcgtcgtttttttattctttctatcgttttatttaataggagtaatgaatgactatcgctcagtcaaacacacatcttagccctgagaacattcaaaatgtcaaaaatgccattttgcataaacttgtttttgctcttggtgtagaaccgcgtgaagcaagcaaacgtaactggttaaatgcggcattgcgtgttgtgcgtgatctttctacggaatcttggttacaaactcgtcgtagccaagcggcaaatacaagccgtcgtgtttattatctttctatggaatttttaatgggaagaaccttcagtaatgctatgattgcagaaggtgtttatgatctaattcgagctgcgtttgacgagctaggtcaaaatcttgaagacattattaatgaagaaggcgatccaggcttaggtaacggcggcttaggtcgcttggctgcatgttatatggacagtcttgcagcaatgaagatccctgcgattggctacggtattcgttatgaatacggtatgttccgccaagagataaaaaatggcgaacaagttgaaaatccagattattggttagaaaatgaatttgcgtggccttacttacgttcaagtaaaaaattccctgtacgttttggtggcagaacttggcaagaaggcaaaaaaaccgtatggcaacctgatgaagaaatcattgctcaagcccacgaccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccaggatttaaaaccactgcaaccaacagcttacgtctatggtctgcacacgcaggggaaaaactatttggtttagcagactttaaccgtggtgactattttgcagcaatgagccaacaaaatagctcagaaaacgtttctcgtgtactttacccagacgattcaacttacaacggtcgtgaattacgtttacgccaagaatatttcctttgctctgcatcagtacaagacatcgttcgtcgtcatgaagtggaatcgggatcttgcttaaatcttgcggaaaaagtggcaatccaccttaacgacacccaccctacccttgcgattcctgagttaatgcgcattttaattgacgaaaaaggttatagttgggaacaggcatggaatacgactcgcaaagtattcttctacaccaaccacactttaatgagcgaagcgttagaaacttggcctgtggagatggtggctcgtatcttaccacgtcatttacaaattatttttgaaatcaacgattggttcttacaagaggttcgtcagcaattcccaaatgatgaagaattaatccgtcgtgtatctattattgacgaacaaggcgaccgtcgtattcgtatggcgtggttagccgtgattgcatcaggcaaagtcaatggcgtagccaaaattcactcagacttaatggtggagtctatttttgccgattttgcgaagatctacccagatcgcttcaccaacgtaacaaatggtgtaaccccacgtcgctggattcatatcgctaatcctggacttgctgcaattttagataaacgcattggcaaagaatggcgtaccgatttaactcagttagacaagttcaatgcctttgttgatgatgcagatgttcaagctgaagtggctgcagttaaagtagaaaataaacgtaaactcgccgcttatatagaacaaactcaaggcattaaactcaaccctgaagcaatttttgacgttcaaattaaacgtattcacaaatacaaacgtcagcaattaaatgtgttacacatcattgctcactataaccgtattttaagaaacccaacagcagattggcagccacgcgtctttatctttgcaggtaaagcagcaagtgcttactatgcagcgaaaaaagtgattcgtttaatcaacgatgttgcaaatgtgatcaacaacgacagccatattcgtgatttaatcaaagttgtctttattccgaactacagcgtaagccttgcacaattaattattccagcagcagatgtgtctgagcaaatttcccttgctggtacagaagcatcaggtacatcaaatatgaaatttgccctaaacggtgcattgacaatcggtacccttgacggtgcaaacgtggaaattttagatcgtgtaggtaacgacaacatctttatcttcggtaacaccgtagaacaagtggaagagttacgtcgtaacggctattcgccgtatcactactacgaaaaagatgcagaattaaatgaagcgatttctcaaatcttaaacggtaaattctcaccagaagatccatatcgctatcaagatttaattctctcatcaggcgacttctatcaagcctgtgcggatttccgtagctatgtagatgctcaagagaaagtagcaacctacttccgtaataagaaagcgtggacacgttctgcgatcatcaacattgcgaatatgggctacttctcatcagaccgctctgtgttagattatgcgaaagatatttggaaaattgaaccaatgaacgaaacgcaattatcttctcagccgaaagtagcggatatgatgagtaatgcgagtaagttgttagttataaaatgattttataactaatagactaagatacactctctagacatttggaaattctccattctactattgaataaaaatggagaatttctatctgtgctcatttataccttcctccaataaattagtgtctgacatagccccacacaaaatttaacgaataacctcgacaaatatatgaaatatttgggtataatcgtccgcttgtatgagggagaaattaagtgatggaaagttttttacacggttttgtggtctgttttgggctgattgtgtctattggtgcacaaaatgcatttttattgaagcaggggattttaaaacagcacgttttttgggtagctctactctgctttctttgtgatgttgcgttgatgagtatcggtgtattggggcttggttcgcttatttcgcagtcacctaccgctagtttatttcttgctctgtttggtgcgatttttttattcacttatggtagtcgctcttttatcactgcttatcaaggctcaagtcagctattggcacaacaagggcaagctaagtcgtctttaaagaaagtgatcgccattacccttgcgattacattacttaatccacacgtttatattgacactgtggtgattgtcggtggtattggcggcactttaagtttcacagaaaaaatacactttttacttggagcattaatttgttcatttttatggttttttggggtcggttatggtgctggtttactttccccttactttgaaaaacgtcgaacttggcagattttagattttgtcacagggttaattatgtatggcattgcatttagtttaatcgtgtatacagtgaaacttattgaatgaagtagtcgccctttatttctattcttctatcatcaaccatcctctttataatgttaattttttgtaaaaattcgacttatatcacagtttttctttaaaaaatccgtcataattggggggatttgtgtgactgatttataagtaagcatttctctttgactttttgcctttatttgtactgaaatgtatataatggcagcaaatttaacaactttgtaaacagataaaaataaggttaggtctttatgcaacataaaaactttgacgattggattgcaactactgcattaggtggggcaaatcagtcttatgttgaggaaatctacgagcagtatctagaagatactgatagcgttgatgcaagttggcaagcggtatttgctcaactgccaaaagctacccaagtagagcaacctcattccagcgttcgtgattatttccgtcgcttagcgcgtgaaaatcgcagtgaggcggtgacagtgattgatcctgaagccagtgcaaaactcgttaaagttttacagttcattaatgcctaccgcttccgtggacatttggaagctaaattagatccgcttaattattatcgttggaaaacctcacaggttcctgaactcgattaccgttaccacggtttcagtgataaagatttagaagaaacctttactatcgggcgttatgtttataacaaagatacgatgaagctaggcgaacttgctgaggcgttaaaggaaacctattgcggtagtatcggtttggaatttatgcacattcaggatatggagcagaaaaattggcttcaggcgaaaatggagagtgtgctgaataagccgttgttcactaaagaagaaaaagtaaatttattaacggaactgaccgctgctgatggtttggagcgttatttaggggcgaaattccctggggcaaaacgtttctctcttgagggggctgatgcttttattccgatgatgaaagagattatccgtcacgctggtcgtcaaggtatggaagatgtagtgatgggaatggctcaccgtggtcgtttgaatatgttagtcaatgtgttaggtaagaaacctgctgaactttttgatgagtttgctggtaaacacgctgatgataatcgtacaggtgatgtgaaataccatcagggcttctcgtctgattttgatgtggacggtaaacacgttcaccttgctcttgcgtttaacccttcgcacttggaaattgttagccctgtggtgattggttctgtgcgtgcaagacaaactcgtattcacgatactgaacataagaaagtattggcgatcacggttcacggcgactcggcggtggcaggtcaaggggttgttcaagaaaccttgaatatgtcaaatgcgagaggttacaaagtaggcggaacaatccgtatcgtgatcaataaccagatcggttttacgacttctaatccaaacgatacccgttctacggaatactgtaccgatattgccaagatgatccaagccccgattattcacgttaatggtgatgatcctgaagcggtggcatttgcagcgagaatggcggtgggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgagaatggcggtggaatatcgttgtttatttaaacgtgatatttttattgatttaatttcttatcgtcgtcacggtcataatgaggctgatgaacctttggctactcagccgatgatgtacggtattattaagaaacaccctacacctcgtaaagtttatgcggatcgtttgattgctgaaggggtgattacaggtgatgatgaaattgagatgatgaacctctaccgtgatgcattagacaatggtgatcgtgttgtgcctgaatggcgagaaatggatactgcgtcaatggattggttgcaatatcttaattatgaatggacgtcgccgtatgaaagcaaattccctgaagctcgtttcttagaaatcgcgaaacgtgtgtgcgaatatccagaagcgttacgcccacaccctcgtgttgaaaaaatttataacgaccgccgtgagatgtatcaaggcaataaactgcttgactggggtatggctgaaacgatggcttatgcaaccctgcttgatgatggtactcacgttcgtctatcgggtgaagatgctggtcgtggtaccttcttccaccgtcacgctgttgtgcataatcaaaatgatggcacaggctatgtgcctttaacgcatttgcacgcaaaccaagggcgttttgaggtgtgggactcggtactttccgaagaagcggtactggcatttgaatatggttatgcaacgaccgatccaaaaacattgacgatttgggaagctcagtttggtgactttgcaaatggggctcagattgttatcgaccagtttattagttctggtgaacaaaaatggggacgtatgtgcggtttagtaatgttactgccacacggctatgaaggacaaggccctgaacattcatcagcacgtttagaacgttacttacaactttgtgcggaacagaatatgcaagtctgtattccatcaacaccggcacaggtttaccatatgttgcgtcgtcagacgatccgtaaaatacgtcgtccactgattgcgatttcgccaaaatcgttgctacgccacccgcttgcggtttcaacgttagatgagttgatcaacggtgaatttaaaacggtgatcggggaattagataatctcgatcctgcacaggttacgcgtgttgtgctttgttcaggtaaagtctattacgatttactggaagaacgtcgtcagcgtgggcaaagcgatgtagcgattattcgtattgaacaactttacccttatccacacgaagatgtgaaaaaagcactgataccttatgctcacgttactgattatgtttggtgtcaagaagagccgttaaatcaaggtgcttggtattgtagcaaacacaacttcgaagcctctattccagagaatgcgacattgaaatatgcaggtcgcccagcttccgcttcaccagcggtgggatatatgtcacttcataccaaacagcagacacagttggttgatgaggcattaagcgtttaattgatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagaatttaaatagaaggaaacaacaaatgacaatcgaaatcctcgttccagatttacccgaatccgttgcagatgcgaccgttgcgacttggcataaaaaagttggcgatagcgtaaaacgtgatgaagttattgtagaaattgaaaccgataaagtggttctcgaagtgcctgcgactagcgatggtgtgattaccgaaattcaaaaaggcgaaggggcaactgttgtaagtaaacaagttttaggtattttagttactcagcaagcaggtgatgtgtctttagcgacaattaaacccgtaaatgaagcaaccccttcagatcgtcaaaccgcctctttagagccagataatagctcggctgacgcattaggcccaagtgttcgccgtttacttgcagaacacgggctagaagccagtgaagtgaaaggttcaggtgtaggtggcagaattactcgtgaagatattgaagcggttgtggctaaacgtaatgcgaaagtggctgagaaagttgaaaatacgatcagcacagtggcttactctgctcgtagtgaaaaacgtgtgccaatgacccgcttgcgtaaacgcattgcagagcgtttattagaagcgaaaaatactacggcgatgctcaccacattcaatgaagtagatatgaagccgattatggatctgcgtaagcaatacggtgaaaaatttgaaaaacaacacggtgtgcgtttaggctttatgtcgttctatatcaaagcggtggttgaagcattaaaacgttatccagaggtgaatgcttctattgatggcgatgatgtggtgtatcacaactattttgatgtcagtatcgctgtttctacccctcgtggtttagttacccctgtgttacgcgattgcgacaaactttcaatggcagacattgaaaaagctattaaagcactggcagaaaaaggacgcgatggtaaattgactgtagaagacttaacaggtggaaacttcactatcactaatggcggtgtctttggttcattaatgtccacgccgattatcaatccaccgcaaagtgctattttaggtatgcacgctattaaagatcgccctgtggctgtagacggtcaggtggttattcgtccgatgatgtatcttgcattgagctatgatcaccgtttgattgatgggcgagagtctgttggtttcttagtagccatcaaagatttactcgaagatccaacacgtttgttgttagaaatttagaatgaacatttccccctttgaaaaagggggaaaacagttttaatcacataggaaccccaactctatgaacctacacgaataccaaggcaaacagatctttgccaaatataaacttcctgtcagccaaggcattgcttgtaaaacggcagatgaagcggttgaagcaatcaaacaactcaaaggcgacgcttgggcaattaagtgccaagtccacgcaggcggacgtggtaaagctggcggtgtcaaactggtacgaaatgaagcagaagtgcgtgaatttgcagacaaatggctcggcaaacgcttagtgactttccaaacagacgcaaatggtcagccggttaataccttatatgttgaggaaacagtagggattgcccgtgaactttatttaggggcagtaattgaccgctcatcacaaaaagtcgtttttatggcttcaagtgctgggggaatgaatatcgaagaagttgcggctaaaacccctgaattgctacataaagtcgctatcgatccgcttgtaggtggaatggcatatcaagggcgtgaactagcgtttaaacttggtttaacaggcgatcaaatcaaacaattttgttttatcttcacacagcaggctaaactctttgtagaaaaagatctttccttactcgaaatcaacccacttgtcgttaccactgaaggcaatttactttgcttagatgccaaaatggtggtagatggtaatgcgttatatcgccagcctgaacttgccgcaatgcacgatcctagccaagatgacccgcgtgaagcccttgccgagtcgcaccaacttaactatgttgccttagatggtaacatcggttgtatggtaaacggtgctggacttgcaatgggaacaatggatatcgtcaaattacacggcggtttcccagcaaacttcttagatgtaggtggtggtgcaaccaaagagcgagttgcggaagcatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgcggaagcatttaaaatcatcttgtctgacaaagcagtgaaagctgttctcgtcaatattttcggcggtatcgtccgttgtgacttaatcgctgacgggattatcgcagccgttaatgaagtaggggtaaacgtacctgttgtcgttcgcctagaaggaaacaacgcagaacttggacgtgaaattttagcgaaaagtggcttaaatatcattgcagcagcaaccttaacagatgcggctgtagaagcagtaaaagcggcagggggtaaataatgtctattttaatcaacaaagataccaaagtaatctgccaaggttttacaggcggacaaggcacattccattcacaacaagcccttgattatggcacacaacttgtcggcggtgtttcaccaggcaaaggtggcacaacgcacttgggtttaccagtatttaataccgtgcgtgaagcagtggaagctacaggggcgacagcaacggttatttatgtaccagcaccgggttgtaaagatgctattttagaagccattgatgcaggtattcagcttgtcgtttgtatcacagaaggtatcccaaccttagatatgcttcaagtgaaacagcgtttaaaccaaacaggcgtgagaatgatcggccctaactgccctggcgtgattaccccaaatgagtgcaaaatcgggattatgccaggcagcattcataaaaaaggtaaaatcgggattgtttctcgttcaggaacattgacttatgaagcagttaaacaaacaacagactacggttttggtcaatcgacttgtgttgggatcggtggcgaccctattccaggttcaaacttcattgatattctaacactattccaagctgaccccgaaactgaagcgattataatgatcggtgaaattggtggttccgcagaagaagaagcagcagcctttatcaaagcgaacgtgactaaacctgtggtgagctatattgctggcgttaccgcaccaaaaggaaaacgtatgggacacgcaggggcgattatctctggcggaaaaggcactgcagatgaaaaatttgcagctcttgaagccgcaggcgtaaaaactgtgcgtagtttggctgacattggggtagcgttgcaagcggtgttaaataaataaccgcttgttgatcagaaccgtagaagcatgcctaatctggcaggagctgtaattatagaactggcagattaggtttaatctttacgatgaaacttgctctttagagcaattatttactgtcttacacagaaaaactatcttcagaaccttttcttatatttagtggggggaattaaagaacccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaaagaacccagcttcttttttctcccttgctctttccaaaatattctgaatttcgagcattgtttcctgatcttcagctagtgcaatttttcgcatttcttcattcttaaagagttctaaattaggatcatagacttccgccattaatttcacattatggcgatctcgttcaaaatagtagtcacaaatttcatcagcaacttcttcctcaacacctagcatttttaaggccgcacgtccactgcgtaaggcagaatcaaaggtctcacgcacttgtttatctgctcctgctttgtaaagttcaaagacatgaactcgatcgtatgcccttgcgataattttgatattcgggttcatagaacgagccagctccacaatatgtatcgcttgatgtttatcatctaccgcaacgattaataattccgcagtttcaatccctgcattgtgaagtaattctggacgagtagcattgccataatagcttttaattccgtactttttcgccccttcgatttgcgcttcgttaagatcaataatagtagggtgatagccagacatcgtgaggatatgattgacgatttgtccataacgcccaatcccaactaagataatcgggtgctgttcttcaatatgagcggcttcacgttccccagctttgtttgcaaaacgaggtgctacgaatttgttatataaaatgatggtgattggggcaaaaatcattgaaaatacgacaatagcggttagatttgcttgaatttctgcagaaatcaccccttgtgttgccgatgctgcatatagtacaaaggcaaattcaccaccttgagccatcacaacagctctatccattgcatcgctggtgctacttttagcaagtttggctattaataaaatacacaatgatttcactgccatcattgcaatcactgccgaaaggattagaacccagttatcaaacacaatgtttagatctaatgccattcccacacctaagaagaataagccaagtaataaccctctaaatggctcaatatcggcctctaattggtgacggaaacttgattcggagagtaaaacccctgcgacaaaagcacccattgctgttgataatccaccttcctccattaataacgcagagcctaaaaccacaaatagtgcggctgccgtcattaattcacggattttggtttttgctagaatacggaaaatcgggttgagtacccaaataccgaccaccaccaatgcggtcacagataaccctgcgataccgattttctgccaaataggttggggatcggcaatatgatttggatctgtcggtgcaagaaaggtgacaatggctagtagaggcacaataatcagatcttcaaaaagcaagattgacaccattcgctgaccacgaggactggcaatatcgcctcgttcgcttaatacttgcattacaattgcagtagatgttaaaacaaagcctgctccaccaacaaaagagatttgccaagaatagccaaacgccataccgacaaacgtaagcaagaccgcacaaacgaccacttgcatactgcctaagccgaaaatttgacgacgcagcccccataagtaagatggcttcatctctaacccaatgataaatagaaacatcacgacacctaattcggcaacgtgaatgatcgcttggggatctgagaaaagttttaaaccaaaaggacctatcacaagccctgcagctaaatatcccaaaactgagcctaagctcaaacgtttaaaaataggtaccgcaataattgccgcccctaacagtgtcacaacactaactaattgacttgcaccttctgccgccattgattacctcaaaaaataaaaaattaaaccgtctaatgtttaaatctttttatagacgggtaattcatattgtaaatataaaataaaattagataaatgcttaatttaaaaattaattatctaccataatgaaagaaacaatagctctaaattacttcataggagcagagtgatatctcctcctaaacaatacgaaacaagggcggacacatcggtccgcccctactttggtaataaattgataaaaagagatcgcttgtagggattatttaataacctctacaccacccatatacggtttcaacacttcaggcacggtaatagaaccatctgcattttggtagttttcaagtacggcaacaagcgtgcgtcccacagctaaacctgaaccatttagggtatgaactaaacgagttttcttatcccctttcgctttgcaacgtgcttgcatacggcgagcttggaaatcccacatatttgagcaagatgaaatttcacggtaggtattttgtgccggtagccacacttctaaatcgtaggttttgcttgaaccaaagctcatatcgccagaacagagtaacattttgcggtatggcagattgagcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcctgttaattcttcaagggcttccattgatttttcaggggcgacgatttgtaccatttctactttatcgaactggtgcatacgaattaagccacgggtatcacgaccgtaagaacctgcttctgaacggaagcacggggtgtgagcggtcagtttcagtggtaaactttcttcgtctaagatctcatcacgcacaagattagtaactggcacttctgcggttgggattaaagcgtaaggtttttgtaccgcatttggatcctgtccttctaacggttgagtatggaacagatcttcgccgaattttggtaattgccctgtgccgtaaagagtatcgtggtttacaagataaggcacataggtttccacatagccgtgttgttctgtgtgtaaatccaacataaattgagataaagcacggtgtaaacgtgcgataccgcttttcattacaacgaaacggcttccagttaatttcacaccagcagggaaatccaaaccgcctaaaccttcaccaagggtaacgtgatctttgatttcaaagtcaaattgacgtggcgtaccccagcgagatacttcgagattttcgctgtcgtctttacccacaggcacttcatcggctggtaagttaggaatgtttaataacaactcacgaatttccgcttggactttatctaattccacttttgctgcatctaattcgctacccatcgtatctacttctgtcagtaacgcagaaatatcttcgccacgtgctttcgccgcaccgatattttttgaacgagcattacgctccgcctgtaaattttctgctttaacttgcaatgctttgcgttgttcttcaaggctagtaacacgagcaacatcaaggttgaagttacgtttgagttttaaaatttgtgcgacttcctcaaggttcgtacgcagaaggttttggtcgatcatttttgtgtccttataaaatcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaggttaattggttttatattcgttttttgataatttgagtaatatgtgtaatcacattttcaatactagaaataacttccctattattgaaacgcaatacatacaatcctagtgagtttaatgcctgatctcttattttatctgcttctatatgctctacttcataatgttggctaccatcaagttcaattacaagttttgcttttgggcaataaaaatcaacaatataagttaaaattggcttttgacggtaaaattgtagatctaaaagttgttttctacgcaatctagaccataagatatgctctgcctttgtcatcgtattgcgtaatgttcttgcatttggtttaagttggaatagataaggttccataaatattccttaacattcccccctttgaaaaagggggactaggggatatttcctacctattcgcatatttcctacctattcgcattcttcataatccgctgtttagcaacttgccactcacggtctttaatatcttcacgcttatcgtgcaattttttccctttcgccaagccgattttgactttcgcccacgcatttttccagtaaagcgacagagcgacaacggtaaacccatcacggctgactttaccataaagcgtgtctaactcacgcttatttaacaataacttacgggtacgggttggatcgcatacaatatgggtagaagcaacatttaacggggtaatagtgccaccgaataaaaaggcttcgccgttgcgaaatgtcacatagctatcgccgatattggctttacctgctcgcagggatttgacttcccagccttgtaattctagaccagcttcgatttcttcttcgataaaatattcgtgtctggcacgtttatttaaggcaatcgtatttgaagctacttttggttttttactcatagtgctattttttattaagaaaattaatgagattgtaccttaaatccagcctattatgtagcaaatgcccaaattttttatattacatttgcttactaacactattctgttgggaatttatcaatcaaacctatctgcaagcaaaaattgcaatacagcatccattcttaaatgggggattggctgatcaaagtcgatttttttcggttcaaactggtcaaactcaaagcggtgattttgccagtagttgatgtcgggtaagcggtttgggacgctaccagggtagagtgtaaccagttttttatcactagagcgaatcccacggatcgctttgaaactttgtccattttgtgtggcgatcactggatcggtcgctcggatagcggaaatcgcttggtagcctgtgtcaatgccttcaaattcagcgtgtcgccccccttcttgcactaattgtcgcattaggctttctaaattcggtagttggtcgctggtgatatgatcggctttggtggcaacaaacagtaacttgtcgatatttgatgaaaataggcgactaaaaagcgagcggttgccataatggaaatgtttaaatagctgttgtaagcctgttttcatttcaataaaggcttgatggctgtgatttaacggggtaaggcaatccgctaagatcacttggcgatcaaactgtgagaagtaatcttcataaaatggtttgacgattttttgttgatagtggcgatagcgtttttttagggtgtgaaaaatgctatgttcagggcttttttctagttgttcccattcattttcgcttaaatcaagcagggggaagaactgatagacaggcgcaccccgttcggtatttggcaggacaaatcgccctggttggatatattgcattccaacttctttgcatttgagtaggtaagcggtgtaatcttcacttaattttgcaagttggttttcgtccgttttggcggtgagatcgagttgttttacttgagtaagccaagcctgtgctaactctgcccgttcgcctttgtgtacttgctgttgatgttgcgaccactctttgaaactttgtgagagtagcggtaaatctaataaccattccccaggataatcaaaaatatcaagatagagtgtgcttgtttctttgagatggcgaagcaggctatctcggcgttggtagcggatcgcaaggcggatttcgctgatccccgtggttgatggacaccaagtcgctggctcgttttcaaagcagtagcggtttttgtcgtattcaaaacggggaacggtgagatcgtgctgttctactcgttttacggaaagaatttgtccgtttcgagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataggtttaagtggacgttgtcgccggtgccgatgtgtagcagttgatcgactaaactggtgatgaatgcagttttaccactgcgacttaagcctgttacggcaaggcgtaggtggttgtctaaaccacgttgtacgaatttgtgtaattgatgttgaatttgattaaacatataccgaaaattaccagcctaatgctttatgagcaacgacattacgagccggtgaaaaatgagataaaccaaatagggcaaggttgcgagcgacttgcataggcaaaaattcgcaaccaaaaatcgaaatcagaccgcttgtgctttgcattattcgggcttggtcggcttggcggtgttgttcaaactgttgtaaccatttggcttcgccgaaatcttcgccttgagcaaaggcttggccgacaagggttgccagttcaaacagatctcgcattccgagattgaatccttgccctgccactgggtgtagcaactgggacgcattgccgacaatggctaaacggtggtgaatatggctttcgcttttttgcgaagaaagggggtaaacaaaccgcttgctgacttgtaaaaatttgccgagcttccagccgaattgttgttgcaaggcgtgtaaaaagtcgctagatcggaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagtcgctgtctgacattgccattgcttctgtcggatcttccatacaccaaaccagcgacatcattttttcattgagtggcaataaggcaaaaggcccttgtttcgtgaaacgttcaaaggcgtggttttggtgtggttcagacaggataacattggcgataatggcggattgttgataatccttgataaattgggttgttacgccacattgttgggcaatctgagattgaatgccgtcacaggcaactaacaatgtggacgttaattgtgttccgctgtttagggtaatgtggcagtgctgttctgtgcgttcgatatgggcgacggtatcagggcagaatagctgaatgtttggttgcttggcgattaatgcggtcagttgctcgcccagtttggctaattccactaccacacctaattcggataaacgtagttcgtcggcttttaaggttgttttgccgaaatgtccttgatctgaaacgtgaatttgtttgatgggggttgcaatacggtaaaccagttgagctaaattttgttccgtggcaagcggtcgaatttgagctaacttttgcaaactgccgtaagcaaaggcgattgaacgtgcgtcaaaaccgccttgttgtgcatagtttggctcatttttttctacgattgcaatttgcagttggtgtccgcttactgaacttaacgctaaggcaagtacagaacccgtcaccgcaccgccgacaattaccacatcaatgttttgtttcatttggggattctccaaaatttacttccccctttgaaaaagggggattgagggggatttaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattgttattttacttcaatcaataccttaccactttccgctttcaataatctgccgacagggtaaagggcgacattggcattttttgcaatttgtttcacactttcaaccgcttgtggcttaacggcaattaataaaccgcctgatgtttgtgggtcgcacaaaatcgctttttgttcatcacttaatggcgaaatcagatgtccgtagctgtcgaaattacgggtagttccgcctggcacagcaccttgtgcgatgtactctctgacaccgtctaaggtttggatttgatcgaaataaacttcggcacgcaagtttgaaccttggcagatttctgttaagtgtccgagtaacccgaaaccggtgacatcggtcattgcggtgatctcatcaactttggcaaattcagcaccgatcaaattcatctgacacatcacatctcgtgctaaattttgatgttcaggttttaatttaccttgtttttctgctgtggtaagtacaccgatcccaagtggttttgttaaatataaatcgcaattggcttgtgctgatgcgttctttttcacttgttcggtagaaataatgcctgtaaccgctaaaccaaaaatcggttcaggggagtcaattgagtgtccaccagctaacgcaatgcctgcttgttggcacgcaaaacgaccgccatcaacaattttttgtgcaacttcggcaggtagcttattgattggaaagcctaaaattgcaatcgccataattggcttaccgcccattgcaaaaatatcactgattgcattagtcgcagcaattcgcccgaaatcaaaaggatcatctacaatcggcataaagaaatccgtggtgctgacaatgccgacaccgttaccgatgtcatagaccgccgcgtcatctttggtttcattaccgactaacaaattcgggtcgataaacttcgcctgttctgtgtgcagaatttgttcaagcactttcggggaaattttacagccgcagccagcaccgtgactatattgcattaagcgaatgggttcgttttgcatggttgcctctttgttcttatttaacctaaataaagataacggaattgtagcagaaaattaagatatttatacaactgctacataataccaaattaaacaaccctaattctggataagaaaaacccatttaaaaacattctgctgaacacttttaaatgggttttcccctttgcgatgtttcgcgttacgctgataacttcctttacctttgcggttttgctctactcgacttctaaacagtttatccgtcaccaaggctttaattgtactctcttgaatttcaccacgctgatgggcgtagcattctgattttgttgattttttcattattttttcctttttgttaaacacgagatgatatatcttcattgttgttagaagatatgtgcgaaattttgccaaatttctgtttaattgtatatatgcacagataaaaaaacggtataatctacggcgttattccttaaggtagtaatgcacagtttttttaataaacaatattgtagggacgccacgcttggcgtctgttttctaggatttcataaaatatctaaatggacgccaagcgtggcgtccctacgttcttactgtgtataactgctattgaatgtttgttattccgcctaaattgaacttcttttcaatgcaagcggtctgaattaagaagaattttacaaaatccaaagaggtgaatatgaaaaaagaagaagttggacaccatttcttagctcgtttgggtaaaacacgtttacgcccaggtggcaaaatggcaacggactggctcattgcaaatggcgattttcggaaagataaaaaagtgcttgaagttgcttgtaatatgggaaggaccgcaatcgaaattgctcaacaatttggttgccaagtgatcggtatcgatcttgatgaagaagccctagaaaaagcacaacacaacattaaagagcataaagttgaagaattagtgcaaattcaacgtgcaaatgccaccaaactgccatttgaagataatagtttcgacattattatcaacgaagcaatgctgacaatgctaccgcaagaagccaaagaaaaggcaattcgtgaatatctgcgagtattaaagccaaacggtttattacttacccacgatttactgctcaatggcgataacagcgaagaggtgatcgctaagttgcgtgatgcgattaatatcaccgtagcacccttaaataagcaggattggaaagatacattccttcattgtggcttccgcaatgttgaaacctttagtggtgagatgagcttgttatctccaaaagggttaattcaagatgaaggggttttaggggcaatgaaagtggtgggtaatgcgttaaaaccggaaaaccgtgatactttcaagaaaatgttccagacctttaatgaccctgaaaatcaactaggctttattgcggtttgtagtcaaaaataatgtaaataacgaaaaagaggtaaatgtagggagacgctgagcgtgtccattgtggtaagggtacgagatattttatctttaccttaaaaacggacacacgcagtgtgtccctaccacaacaaaacaacattatcttgttaattgatatttgtcagtgatccatagtaggtacattaaacgcccctttttttatcatcataacaataaataaacgcaaaacacgacaggatagattatgtttgaaatgttcaaggattggtataaacagaaatttactgatccacaaattgtcgcacttcttgccatcttaattatcggctttggaacgatctactttttcagtgatctcttaatgccccttttgattgccattgtttttgcttaccttttagaatggcctatccgctttctaaccaccaaactcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaccaagaatgctcagcttagtgattgtcttaggcggatttatttctctctctgtctttttgtttgtggtaatgcttccaagtctatggaaccaagcagtgaccttcctaaaagacctgccgagtatgtttaacttgctcaatgcgtggcttgaggctctgccagaacactatccagaattgattgactatgcaatgctcgactccctaatggcaacggcaaaaactaaaattcttacctttggcgactccttattgtcgttttcattcaactcccttgttagccttgtcggattaggtatttatgcgtttttagtaccattaatggtctttttcttactcaaagataaaacgttgtttatgcgttctgcactacgttttatgcctaaaaaccgccaccttgctactcgtgtttggggggaaatgcaattacaaatcgccaactatattcgtgggaaatttttagaaattcttattgttggcgttgtaacttatattattttccttttctttgatttacgctatccattgttactctcagtagcggtcggtttatcggtattagtgccttatattggtgcggtattagtgacaattcctgttgcgttagttgcactctttcaatttggcttatcccctgatttctactacttgctacttgcttttgtgattagccaacttttagatggtaaccttgttgtgccatttttattctcagaagcagtaaatttacacccattaacgatcatcgttgccgtaattattttcggcggtctttggggcttctggggggtattttttgccattccattagcaactttagtcaaagcggtgatcaatgccttgcctaatgtagaagaatcgcaatcttaggcttgcaagcggttgaatttcactataaattcacggctttatttatctcatattatatttattggacgctaagtgtggcgtccctattatttaaaggaactgttgtgcgtgtaaccgatttccattttgacctacctgatgaacttatcgctcgctatccaacggctgaacgaagtgcaagccgtttactttatctcaacggtaatacaggcgaatatcaagatcaacaattcaatgatttacttgaacatatccatagcggtgacttactgatttttaataacacccgtgttatcccagctcgcctttatggacgcaaagccagtggcggtaagttagaagtattggtggaacgtgtattagacgaacatcgctgtttagctcatatccgttcatcaaaagctccgaaagagaatgctgaaatctttctaggggaagataaattaggcgaaggaaatggctttaaagcgataatggtggctcgtcacgatgcgttatttgagctgaaatttgaagaagcacagccgcctttattcgatctgctacaacaggcaggacatatgccactaccgccttatatcgatcgccccgatgaagatgccgatcaagagcgttatcaaacggtatatagcaaagtgttaggtgcagttgcagccccaacggctggcttgcattttgatcatcaaatgctacaaaaactgcaagaaaaaggagtacaaaccgcctttgttaccttacacgtcggggctggcacattccaaccagtgcgagtagaaaccattgaagaacataaaatgcacgcagaatatgccgaagtatcgcaggaagtggtcgataaaattcttgccaccaaagcacaaggcaaacgagtgatctgcgttggcacaacctctgttcgctctatcgaaagtgcagcacaagcggcagaaaaagaaggcaaattaatcgccccattctattcagacacggcaatttttctatacccgggaaaaacattccgtatcgttgatgccctagtcaccaacttccacttgccggaatccaccctaattatgttggtttccgcctttgccggcttcaaaaactgtatgaacgcttatcaacacgccgttgaaagtcaataccgtttctttagctacggtgacgcaatgtttatcacgaaaaatgaaaatgcgttgggggatgttccctaaaaacgaaaacgcttagaaatttacgctacccaccacgcttcctagattctacttatagcaactgtattcttacacagttgctatgtagtcaataaatatgtataaaaattattctacttgaaacaaaaaaggattaatcgcactgcgtgccagccctttttgctccatttcagcatcaaggaaaatcgtacctaaatcatcggcgattggctcaacatgcggatctttatcttgatacatcactttcagataactctcacaatcaccacaactttccgctttcacctctgcgtccatactgtctaagctccagtaatcgagcttgcctgtctgctcacaattactacacttcgcacgcaccatattccactcgctttcacatagagaacagtgcaaataacgtaaaccttgcgtttccccaaaatgaaccacactggcaatcggggcagagttacacacagggcaagtatggcgttcttcaccgtactccgctttggtattgcgaggaagttgctgagttaattgcacccaataaagcgacaagaccgcccataagaaaaccgccttgtctgcgcccacctcttcataacgctcattcaacaaatgatccgccagcatttcaagctcagaatttgaggctttctctaaccattccaatgtcgccaacacagtatccgacgcataaggcttaaacttatcaataaacgccaacagcaatttctgccactcatctgaccgcttaaaggttttcacatctaaaggcttcactccctgatgagcttccaaataagcggtaagttcgcccactctatttgcaataggctgattttctaataaatcaagctgaacctcgacaatatttgccacaaattccaaataatccccaaaaggattatgttcagccaattgtcttaaacgtttagctcggcgagcatataaatttttaggattggcatacaacaacggcggattgtgaaaagagcttgcagcttgttgaatttcttcttggggtaaaatacgaatactcataattttttatacctatatttactaaaaattaaatattacttgctattcaacatctttcggcaatttatataactgatgtttatataaataactgcctaacaatgcgtgggccagtgcctcttttttcattgcttcagactgctcttttgggttaaggcgttcattcgctttatcatattcataaccttgaggagattgatttggcttaagaataatcacatctttgcctttcatcattgcttgcgtttggtcgtactgcataaacgcacgatttggatcgacattttgagttaagtcaaagccaatcatcggataatcgccactaatgcctgcgacagataacaatgtcgttggcatatcaatttggctgaccaaacgattatcacggcgaggctcaatatgttcccctaaaattaaggctgggatatggaaatgtttgatcggcacaagactatcacccgctactcgcgagtcgtggtcagcaatgacaaggaataccgtatctttccaataatttgattgttttgctaatttgaagaaatgccctaacgcataatccgcatattttgccgcattattgcgggtctgtttctctttatcaaacaactcaattttaccgtctgggaactcaaatggatcgtggttacttgaagtaaagactaagctaaaaaacggtttatcgccttttgctaattcggtaaaggtttcgtgtgctttatcaaataaatcttcgtcactcatcccccaagtggaaacgaactttggatttttataatctttctcatcaatgatggtttcaaagccatttccataaaaatagctcgccatattgtcgaaatgtttttcaccgccataaatgaaagaggtgcggtaaccttgacgacgcaataattctgcaatggtaaagaaaccgttttggcttttggttaatttcactgttgcacgcgctggcgttggtgtaaaacctgcagtaacagcttcaataccacgcacagaacgtgtgcctgttgcgtaaatattttcaaacaaccaaccttctttagcgagttgatcaaattcaggagtaagtggcttaccgcccaatgtgccgacaaactgagcgccaagactttcttctagcacaataacgatatttttaggcttaccttgatagcttgccacattcttggttaatgtcggaataaccgttgaaatataatcagaagcggggcgattacggctattttttacaatctcaaacatctcttgttcagacattttgccatattgctctgaagatttttcttcatctttcagctgttgtacggcatataatacagaatagcctgaattgagaaccaatgaattaaccagcggatcgcttgaaaatgccaccattgcagggttaatgccacgatgtcccaatgatgatcttgccccagcaaacgccacagtaataatcaacaatgccattacaggacgcagtttccagctaggtaaacgcagatgttgcacagcccagccagacagtttccaataaataatgcctgcgactgtagttgcaaccaaactgctaatcaccgcagtcaaatgcccattggctaacattgtaaatacttcttttggataaagtagatactcaataaatagacgatttgggcggaaatcataggtttcaataaacgcaggggtggcgacttccataaatagaataaacacactgcttatcgtaagccaaacgcgtaaaatacctttccaaagtgtgcctaacccattgttatgcaccaataacaccgtaaataatgctggtacgccaaagagataacaaatggagacaatatccatccgcaagccttgtaggaaaagaggaaaccagccctcaaccgcagaaacacgatctgcttgccacagagataatccaaggcgtgacaggctgaaaatcattaaatttaatccgataaagaaaaaaatcggaaacaaaataaagcgggtatttttttgcataaaattactctgaaattgtaatgtaatccccaactcgaataacaccgcttgtttgtggcactaaatgcaccccaaaaattggcttgcctttctcattggtgtggtgttgttttaaggtccgaaaaggttctgtattcggatctaattcaagggtctgtggatctcgggtaattaaaatacagcgtgtgcaaggttgagccacctcaaattccactgtgccaattttcaccctcttccacccttcttcttcaaaggcttgaatgccatctatgacaacatttgctcgaaactgttccattgaaacaggcacaggcgaccattgttgtagttgttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggattgctcagataccaataaaagcggattactgtctgcaaaacttaacggttgaggttcacaatgttttaccattcgttgtggctgttcgcctaaccaacgtaactgaacttcacgcccaaatttttggcttaaccattgatttactgtactattcgccacccaagatggaaaatgacttccccaaacttcgctagatcgctgttgagtaaaatcgttatacagtgccacacatcgctcgccacaatcagattgaatgacaattcccgttgaaatgggaaatgtagctaaacgatataacatctgttctttgcgagccgtgataaaagttccatctacttcggtaatcataaattcacggtcaaaattcagaccttgtggcaaaacaaaagcctgctctacccgatacgcctgagtagatttaatcggataaagacaaatttgtgtgacttgcataagttcccctctaaatttaggcgataaacaatagcagaaaatcatctacttttatatcgttctcaagtaaaatatcgggattatttgaaaaggaatagactatggcaaagaaacctaccctagattttgaaaccacactcaaagagcttgaggaaatcgtcaatcgtcttgaaacgggcgatcttcctttagaagaagccttaaatgagtttgaaaccgcagtaaaattggtgcaacaagggcaagaacgcttacaaaaagcggaacaacgtatccaaattttgctacaaaaagatgaacattcagatcttacggattatccataatgaattacgaccttttcgctgaattaagccaatatcaacaacgtatcaaccattttttaagcgagcaactttcgcaatatccagcctacaacacaccgcttgttgaagcgatgtcttatgctgttttgcttggtggcaaacgagttcgccctttcttaatttatgctacagggaaaatgctaggcgtgccacttgctcaacttgaccattcagcaggggcaatggaagccattcacgcctattcattggttcacgatgatttacctgcaatggataatgatacccttcgtcgaggcaagccaacttgccatattgcttttgatgaagcaacagctattttggctggcgatgcactacaaagctttgcctttgaattactggcatttgacccaagtctaaccgcagagcagaaggtggcacaaatgcaatggcttgcaaaatccgctggggcaaaaggtatgtgtttggggcaaagtttagatttacaatctgagcataaagccattgcccttgatgaacttgaacgtattcatcgtaataaaactggggcgttgatccttgcctctgtaatgatgggatttaatctatccgcttacgcccaagatcatcagattaaacaacagcttgtacaatatgctgaagcaatcgggctggctttccaagtacaagacgatattcttgatgtgattggtaatagtgaggtcattggtaaaaccgcaggttcagatcaagcgttggataaaagcacttatccaaaactgctgggtttagagggggcgaaacaaaaagcggagagcctctaccagacagccctaaaagcactagaaaccttgccttttgatactacggctcttgttgctttggctgaatttattgtgaaacgtgaaaattaacccctgtttacaggcataagagtagtacttatgcctatttacttatcaatgatttaacccaagcattatcataaacaatgccccttgcacttcagcttcaggaacatctctgccattcaaattgactttcccctgatcaatggatagcttcattttcaggctatctttatccaaagtagctaatgagctggcttgagcttgataggcaaactcactgatcgtttgttttgccttctgttcagcgtcttctttcgggaaaccatctagttgatttagctgtgccatgaataattctaatgaaggcaacttgaattgagtgtctaacacagacgctttaaagatttttagaacatcttccattcctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttagaacatcttccattcctttgaattggcttggatcaaatttatctaaatttagatttaaagacagactatttttccctttcgcattctctaagctaagctctttaatttgtaatttaggtgatttgttaagaagtgataacaccacatcgccagcttccacagattctaatttttccaaggaagaggcataatgcattaattcattagcactctctgcatcaagctctgccgagctatcaatgttgagcttacctaagttaagtttatcttgagcgagcaactcaccagtaaggctacccgttgaagtccagcgatccttttctaacgtatttttaccctgactggaaagatttgtgaaagcaaaaggtgcttttccgtcagacgagtaacgaaccattttagaactgaactcataattacccaaactaagctctggatatttctcatttgaggtaaaatccgctttgtaaagggtatcttggatttctatcctagtatttgtttgatcttgatattgataggacggaatttggctactgaatttccccgatttttgtgctggatcgtactcgaactcaatctgggtctttgcaagatcccaagtttcacctttgaaagcattgaggctaaactcaccgcttaaattacctgcgtagctaatatccgtttgcccttcggtaaatggggtctgtagcttgaatttttcaggtaaataaagtttgctctcaacgctcatcattgcaggcattaagtttacttggctaagacgatttaacggtagtgggccgtgaaaaagtttatcattgccttgtagctgataacgctcatcaaccgttcctacctctaagatatatttcacatcagaactgaaaaaatggcgttcaaatttcacatctttaatttctgcatctatgccatagatcttcagtgatttaaggctttgattaccttgttgtaccaattgttgatagtgttgttctgcttgtagtccagtgtaccaactgcccccaacgacagcaacgccaagaatgccagccagagcaagggtaattttagttaatttcatcgttgttcctctttattatctctcaagtaaagtgatagaaagcctttggttatgccttttccgctctttctactaaccactcacaaggcgtaaaacgctcgccatattgttgcgtatgcttgcgtaactggcgaacaagctcttttgccccaatcttgttaatataggcatacacaccgcctcggaaatcagggaaatccaccccaaatacagaagcaacgttaccttcatcagttgaacgaataacttgatcttgtaaacaccaacaggcttcatttaacattctcaatacacaacgacgggcaatgtcttcagcttccatatcgtttcgcataatggtttccatcgtgtgataaatgcttttatcctcttgagtgcgtgcccctcttgtgtcgtagagatagaagcctcgtttatttttacgtcctttacgatcatctcccgtcaaacgctcaataaccgtcggtaaagcgaaacgtttacccaattcgctcaccattgcaggattagatttaacaataatatccaagccaatttcatcgatcattgcaagcggtccgatcttaaagccaaattcctgtaaggcacgatcgataaattcgatcccttccccttcggataaacactcaatggcttcaagcaagaatggcgtaagaatacggttaataaagaacccttctttatctgcgacaagcatcggaatttttccttgctggatcgcaaaatgaattgccgttgaaaccgctcgctgacaagttttttcgtgcggaataatctccaccatcggacgtttagtcacagggctaaaatagtgcaaaccgattacattttcagggcgtttggcgacagaagcaatgtcacggattgcaaaggttgaggtatttgtggcaaaaatcgcattttcatcataataattttcgctctcttgcaccatttgctgtttgagttctaatttctcataaaccgcttcaacgataaaatctgtcgatttcgccgcaactaagcgttcaccgcccgtaattaaattcattcgttggatcatttcaccgtgactaagctgtttcttactcactgctttttgcattaagccataacaagtctgcaacgctttttgaatttctgacgggtgaatatccttaattctgacaggaatttgagcattatttgccgtcaagtaagcaatcccagcccccatataaccactacccagcaccgtcacttgttgtacatctcgcacttgagccaagtgttgatattgctccttcatcgctcgctcagtctgcttcaaattcattaatacttgagcttgctccgtgtgcattaacttcaccaacgcattttgctctaaagctaacccagctttaaaatgtggctcttttaacaatgccaacattttctcaactgcaggatagttgccaaaggctttatcccaaacacgattttcaatatgagccagatatttttcacggataaacttattgccctcaagctgtttacgccattttttgaccttatcaagcggatttttatgatccactttttgcactttatggttaagcaacaactgatatgccgtttcaaataaattactggcagggataagtttatccaccagcccaattttcagggctttttccaccccaattttctgtccagatagcaacatcgtgaccgcattttgcaagccgaccaaacgaggcaaacgctgtgttcccccagcaaaaggcaaaatccccgaacgaatttgtggcattgcaaatttggtataaccttcctcgctggcaatacgataatcgcacgccaatgccaactctagcccaacgccataacagccaccatcaatcaccgccaccgcaggcattttgagcgtattaatttcacgcatcaccaactgagcattatgagataaggttttcagctgttcatcatttttaccacgcaaatgatcaggatcataaccttgaataaaacctttctccttacccgaaacaaaaatcacgccccgtgcttgttgataaatcacagaaccaatcacatcgcgtaaatcttcaataaactgctcaggcaaccagttttgcgatttcccttttacatcaatacgaacaatggcaattcgattatcatcaatctcaacgtgaaaaggtgagatatattgtgcttgtgttgtcatactgttactcgctttccaaaatcattgcagaacctaatccacctaatccacttgaggcaatcaaagacaatccgcctcccttgcgtttcaaggcttttaacgattgaactaaaatgcgtaaactggtcgccgcacgaggattaccaaaagcaatagaaccgcccaaatggttcaacttctcaggatcgatttccccaatacaagcggaacgattaagctgttttttcgcaaattcatctgaagcaaacagcttcatattaaccaacatttggctggctgaggtttcgtgaatatcaacaaaatccaaatcagacaagctcacattcgcacgctcaagggcaagatggcttgcaaccgtcgcccccataaacatattttgccaaatatcgttacccgcaatggcatagctacgaatataacctaacggctctaaccccagttctttcgccttgttctctcgcatcaataacactgccgccgcaccgtccaccgtacgaggcatatttgcttcggtcacagtggcataacttttattcattaacggcgaaaatttttcataataagccgcttttgtggcagaggaaatcaaactgtcagataccacaaaatcggtataaggacgaggaaacgaaggcattacttcatcttttaacagccccaatttccacgcattctgagctttgatatgtgaatttaacgcatattcgtcctgagcttcacggctaatgtggaattgctgtgccatctgctcagaaatttccgccacagacatttgggtcatataatctttgagattaactccgtgaggtttaagctctttccacgaaaattcacggaacaagcgatacttatcatctaaggttggcgcattaaaaatcgccttgagcttgtgaataacacgagggctgatactaaaaggcgcattagaaatagaatccgccccccctgcaatccctgcagaaatcgaaccgctaataatacttccagccacatttaccaacgcctgtaacccagataaacaagagctactcaaagtataagcctgcacataaggcatatttaacgccaacgcaatttcacgagaagggttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcacgagaagggttaggaatatcaggctgttgaataacttgtccgaaaacaagctgttcaatatgttgatgaccaacggcagcacgactaagtagctcgtttgttaccactgtacctaaatctgttgcataggaagatttaaatcctgtatcacgatgaacaaaaggtgtgcgtaatccagcaacaatcgccactcgctcaccttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgttaagagattttgtttagccattttatagataattcaagatagaaatgatgcggattttatcacgctttatctagaataaaaaatggctcaatcacatttgattgaaccattccattcgcagtaacaatttatttatagatcatcaatcaccacataaaccttattcacaggtccgtgtacgccgacaactttgattaactcaatatctgccgtagcacttggccctgaaataatgtttacgcaagatggcattctttcgccttgttgggctttgtcgtgtaggattttagctaactgtgccacacggggtaacacggtgctggcacgcaagacgacaatggatttttcaggtaacagactgactgaacgtccaaactctttatctgaaaacagcacaataccgccagattctgttaagccgtattcgccgtaaaccacgccgatattggctttttccgctttgtcgatattcacactgccatctgcattgtgatcccaaacatagctgtcgtatttagcttgtagtgctggcgtaatgcctaaatcaactaaacggctgtcgttattaataatcaccgagccaccgccatatttatcacaaagtgcggtcacttctgcgatcagattttcttctttcaccaccgccacatcggtcatcatcactttagcaaagctaacaaattcctcgactaattgagcttgagtgcgatccgttaagcgtgtcgttggataatcattgactaatttcggcattggttcaggcacgagctgacgtggtctgcccattctttccgccagtttatttagaaaattttcacggttttgtaaatccattctcttatcctctattgttgaaccattcacggaaactttcgccttcagctgacggtaaatcacgggcttttgtccattctgcaagtgcgcctacttgaattggtgctttgccgtttttgatgaatttacctgccacttttgccccgatattcaccccgactttccataaagttgggtgcgagttagcaaagttgaaaccgaaaatcgataaacgctctgctgctggagtcataccattttgagcgatatgttcacggtgttttaagatcagttgtgccagtggaattttcactggacaaacggagttacaagcggtacaaagcgaacaagcataaggcaattctttaaattcttcatagccaccgagtaatggcgagatcaccgatccgattggtcctggatagatagagccgtagccgtgtccgccgatttgacgatacgcagggcaagtgttcaaacacgcaccgcaacggatacaacgtaaaacttctttaaattcgctttcaaggatttttgaacgtccgttatccacgataactaagtggaactcttctggcccgtccgtttcgccttcaagacgtggtcctgttagccaagtgttataggcagtgagttttgcaccaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcaagttaccttcgttagtgactaaacagacagaacctgtttctgctacggcaaagttacaaccactaatgccgatgtctgcctctaagaaatctttgcggatcacttgacgcacaaatgcagtcatttcctctggcgtttctgagccgttatagcccagttgttcgtgtaattcttgacggattttatagcgatctttgtggattgcaggtacaacgatgtgagatggtttatcgccaacgatttgaagtaaatattcgcctaagtccgtttcaaccactttaatgccttcgttttcaagaacgtggtttaagccgatctcttctgtcaccattgatttggatttaacgatcttcttagcatttttttctaaggcaatttgacgaatataagcggtcgcttcttcggcagtttctgcaaaaaagactttaccgccgttttgttgcactttttcacttaattggtagagataggcgtctaaattggcaagaacgtgattacggatctgttttgccgcgtcacgccactcttcccagtggccaagttcgtccaccattctttgacggtttgccccgatggtttcttgggcttttaccaccgctttacgcatcattgcgttgtggatttgatcgtccacgcgttttttaaaggcaagattgctggttttcagtgacatcttatttgccctcctgcattaatacttcggcaatatgcattaccttaatatttttcccttcacgacttaaacgtccgccgatgttcatcaaacagctcacatctgcaccgatcaagtattctggttcaacatcagcaatatgctcgactttttctttgaccatttcgcctgaaatttccgccattttgaccgagaaagtcccgccgaaaccgcaacaggtttgttgattttgaattggtaacaactctaagcctttgacgttttgtaataaggtgattggttcattcacaatacctaatttacgcgacaaactgcaagacgggtgataaacagctttgcctgttaaggttgcaccgacattggtaacgcccagtttattgacgataaaatctgttaaatcgtgaaaacggtcagcgacttttttcgcacgagccgcccactctggttcgccaaagcgttcaaaatggtcaggataggttttaattgcataaacacaagaacctgcaggggcaacaattggataatcattgacttcaaaagtttccactaactttttcattccctcaagggcttgttttgtataaccactgttaattgcaggctgtccacagcatccttgtttttcaaggaaagtgattttacaacccagtttttctaacaatagcacgctattttgggcaacacctgctttgacgatatcggcaatacaggtgacgtaaaaattcacgttcataaaaactccaataaataaaaatagtaaaaaagctaaaacaagcggttggattttacaaattttttggcatttatgttgtaaatctttttatattgtagggacgccacgcttggcatccctactctcaaatatatagccaaatttttatcacaatactccgcttgttcttcaacatttaaaaacgaaaggtggggtaataccccacctaagattacacattgtagaacaacggcacaataaagagtgctgaaagtgcggtaattacaccgtaaacaaacattggcataaccgtacgcttgataatttcaccttctttattattgatgttcaataccgaacatactgctacgatgttgttgatacacaccatattacccatcgcaccgcccacagattgtgcagcaagaattaggctcacagataatcctgtttccattgctgttgaaagctgtacgctaccaaaggttaagttcgatacggtatttgaacctgagaagaacgcccccacagcacctaaataagaggcgaagatagtccagtattcccctgttgcttgtgcgaaactttgaccgatgattttcaccattgaaccatcaccgcctacaagcattaagtttaccattattaacgcacccacaagcgcaaagaatgggtttttcgtttgttttaagcttgttgcgaagatctctttggtatttttcgctgatacagcaaatacagggattgcaattaatacggtaatcacaaacgggattaatgctggcacataaagcaatttgtagtttgagctaattgttgtgccgaaaatttcttttaagctgaaaattaacccgtggctaatatcaaatacaccaagcgaacctaattttacgctgaaccaagaagttgcatcgttcatcattgcttttaatggtaactgtttaatacgagttacaattaagatcgcaattaataaacctgttgggaataaagctttcactacttgtgcagtggttacggcattgctatcaacggtattatccactttcgctaaaccgatacctttgtttgccactaaaacagagatcaccataccgattgcaccgcccactaatgacgggaactcgtagtttaattgagcaattaggaaataagggatcacacaagcaaaaatactgatgtagataaacacgatatttttacgaatttcagaccagctcacgattaaacgcaatgccattactggaatgataaatgcggcaatagagtgaataaatgcagtgatagaaccgatttctaaaatttgctcttcacctaattgtaacgctcccataccaaaccaagtcggcgtacccaccgcaccaaatgaaaccggtacggagttcatcactaatgccaacattgccactttaagcgggtggaaaccgataccgactaaaatcggtgctgcaatcgccgcaggtgtaccgaaaccactcgctccttcaatcataaaggcaaatgcccaaccgatgatcattaactgagccacaggatttgggttgatattcgataaccatttacgcaacacatcggttgcaccggatacttctgaaaaacggttgaaaagcactgcaccgaaaatgacggtaatcggtgtttgtaccgcaatcaaggcagaagcaatattcgcactgaccgtttgaatatcggtgccgaaatagattagctggataattaacaccactaccgcaatccacggtaaagcgacataggaaggtaatgcgttgcgttttaccattaaataaatcagtaaaacgataggaaaaatactgagaaacagagccataaaacacctcaaaaaagaaaacaccataaaagtcaatattgaggctcatattctagtgaaaatttgtaaacaaaaaagcaaaatgttattaaattgtgaaataaatcacataaaaccctatcattcgttcaaaataaaaccacaattattttacaaacaattaagagagattgttttttaatcacttatcagtcattttttaacttatccaaaatcataaaccgacaacggtaactattttgctcatctatttcagaccacttctctgcaatctgttgccactgagtttcatcaaactcaaaaaaagtatcgccctctatattggcttgaatttcagtaagataaagtttatcggcaaaaggcattgtttgtttgaataactcaccaccgccgataatcattatttcatcgctattagcaaaatttttggctaattccaccgcttgttcaaggcttattgcagaataagctccatcaatagcaaaaccagagcgagaaaggataatattcgggcgtttcggcaacagcctgccgatagattcataggtttttcgccccataatcacaggtttacccaaagtattttccctaaaccacgccaaatccacaggcaaatgccacggcatcgcattgtcttttccgatcactttatttaaagttcgagctacgattacgctaattttcattctattcccgattacattttgaaataagccccattttagcagataatagcggtcactttcttttctttttttacacatcattatggcaaaaacaatcgtagtaaaactaggcactagcaccctaactcacggcactaaaagtctaagccgtccacatatgctagaaatcgtaaaacaagttgctcaactgcacgaacaaggacatcgcattattattgtaacctctggggcggttgccgctgggcgtgattacttagggcatcgtgaattgccaaaaacgttggcaaccaaacagcttctagccgcagtcggacaaagccagcttattcaagtgtgggaaagcctcttttccatttataacatcaaaatcgggcaaatgcttttaacccgtgcagatattgaaaataaagatcactttttaaatgcaagggatacgctcaccgccttgctcgatcaacaaattatcccgattatcaatgaaaatgatgcggtggcaacggcagagtttcgtatcggcgataacgataatttatcggcactcgtagcgattttagctcaagcagagttattgattttgctcaccgatcaagaagggttatacgacagcgacccacgttcaaatccaaatactaaacgcattcctgttgttgaaaaaatcacccctgaaattcgccaaatggcagggggaagtggtacaaccttaggcacaggcggtatgagtaccaaaatcaccgctgccgatatcgccacccgttctggcgttgaaacagcgattgcttctggcgaacgtcctaatgtaatttttgaagtggcacagggggcagaaattggcacacgcttcttagctcaacacgacaaaatcgaaggacgcaaacagtggctctttggtgcgcctcctgctggtacaatttatatcgatcaaggggcagaaaacgcattagtagaacagcataaatcgctcttacctactggtattgccaaaatcgaagggcaatttgcgcgtggtgaagtggcaaaaatttgtaaccttaacggcaaagtgcttgcccttggcattagtcgttataacagtgatgctctagcattaatcaaaggcaaaaaatctagcgagattgaaaccattttgggctatgaatttggttcagtagtattccaccgagatgaaatggtggtgcattattaattaatagatcgtagggggaaatatggaacttggacttgatgttgcgattatcttatttgttgcggctttcgtggctggttttattgatgccattgctggcggtggtggtttgattactattccagcgttattagcagtcggtattccccctacggttgcgttaggcacgaataaattacaggcttgtggcggctcgttttccgcttcgctctattttgtgcgtaaaaaagcggtcgatttgaagcagatttggttgcttattttgctgacctttatcggcggttcaatcgggactattttagtgcagatgatagatgtcgatgcattaaaagttgccctcccctttctgatcttaattattggctgttattttctctttagtccaagcctaggcgatgaacaacgtcgccaaagaatgagctttccgatgttcgcttgcacggcggcaatgggaataggcttttatgatgggctattcgggcctgccacaggctctttctttacgctcgcttttgtgttattacttggttttaacctgacccaaagcgttgctcactccaaagtgttaaattttacctctaaccttgcttcgctgattttcttcatcattggcggtgcgattttatggaaaatcggttttctaatgatgattggacaatttatcggggcttcattgggggcgagaatggttgtcaccaaaggaaaacagattattcgcccgttgattgttatgatgtcgtttattatggtggtaaaaatgttgtgggatcagagctattttgcttttataggataatgaatgaacaaagaaaaacgtattgaaattttaacccgtttacgcaatgagaaccctcacccaaccacagaactcaattattccaacccttttgaattattgattgcggtgattttatctgctcaagcaacggatgtgggggtcaataaagccacggcaaaactttatcctgtggcaaatacgccccaagcgattttagatttagggcttgatgggctaaaagagtatattaaaaccattgggctttataacagcaaggcggaaaacattattaaaacttgccgtgatttaattgaaaaacataatggcgaagtacctcaaacccgtgaagaattagaagcccttgcaggtgtaggacgtaaaacggcaaatgtggtgctaaataccgcattcggtcagccgactattgccgttgatacgcatatattccgtgtttctaaccgtactaattttgccccagggaaagatgtggttaaggtggaagaaaagttactgaaggtggtgcctgatgaatttaaggttgatgttcatcattggctgattttacacggtcgctacacctgcattgctcgcaagcctcgctgtggctcttgtattattgaagatttgtgtgagtataaagagaagacggagatttaatcggtataatgcagcagttgcataaaagtcaattcataatggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgcacttgctttagcaagggtacctattacaactgtttgagcatttttcccctcggcgtttgcgcctaagacaacagacctatctttcgcttgtgaactatgccccacggtaactgttccaggcccagttgctgtagagctgttgcctatcgcaatagcgttgtcgtgctctgaacctgtctttgctgaataacctatcgcaacagcagtcctaccttcagcttctgatttctgaccaatagtaatagaaccatgcccaaccttactctctttaccaataccaatagaaccctcgtcacttcctttactcccttgattagaactatcttgaagccatgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaataagtaatccaaatattaaacctaagcctagaacagctcctccgtagataaaatattgaatcataatttcgcgagatgcgacatcttgtattgcttctaaatcacgatttttatttttaataatttctaattctcgctttagaagtgcattttgttcaagtaattcactgctttgtaatgcagattgttgaactctacgttgcatttcagcggtacgttgttgccaatctctatcaatgttgttgagtttggtggttaattcttgaacttgttgttgtaataacggtgttaattcttttgagcttggcgtagatgttaattcggaatttaaaatccacgcttcacggtttttgccatcacgaattagagaatagcgatccctggtttcaattaaggtaactttttcacctgcttgaatagaaccggaaattttgaattgatcgcctggacctttacgcaaataggtattcaaattttcagtaacgtactgtgtttgagcaaaagagggaagtgatattgctaaaagcagagttgagcagaaaagagaaatatgtttttgcataaacaatccttaaaaaatcataaaagaaaagtgcgaatagccgcacttttctgaataaagtcactattctaaattaatagaaaattgcattcaaaatatagaaaattaaaattgagaagaatgcaccagcaggtaaggttacaacccaagatgcaacgatattacgaataactgttaagtttaacgctgcaataccacgagcaaaacctacgcctaataccgcacctactaaggtttgtgttgttgaaataggtaaacctgtaccagaggcaacaacaacggtcattgctgttgcaaattctgctgagaaaccacggcttggggttaggtcagtaataccagttccgatcgttcccattactttgtaacccattaccgctaaaccagcaacgatacccgttgcacctaatggtaaaatccaaggagcgagaattgatttcgcttcaatcacaccgccgttctcaacgatagatactacggcagataaaggcccaatcgcattagctacgtcgtttgaaccgtgagcaaatgccattgaacaagcggtgagtaacattaaaatgctgaacactttttctacaccaccaaatgcaccgccttgtacacggttagcaaaagattggctacggaagtagaagaaacaagtgatgatagacgtaattgagattgcacttgaaatcactaaggtttcagtcattgtaagctgtaaaccaacgtgttttaagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattgtaacaatactcaaaatgaatgtggttaaacccatatagaatggaccatatttttgagcatttttcatcggattatcagtatcaaaaatcagtttttgtgtgctagtaaaaatagcataagcaatgatccccgatacaacaggtgtaacaaaccagctacctacgataccagacaaatcaccccaatgaaccgcttccgcaccaacggtgactaacgcaaaaccgataattgcaccgataatagagtgagtagtggatactggccagcccattttagaggcaagtaataaccaagtacctgcagcaaaaagtgccgacatcatacctagtacaagggtgtctggtctgccagagaattggtgaatatcaatgatgccacttttgatggtttcagttacttcaccgcctgctaaataagcaccagcaaattcaaaaaccattgcaactaaaattgcctgttttgcagtgatagtgcctgaacctacagaggttcccattgcatttgaaacatcgtttgcaccgataccaaatgccataaagaagccaaacactgcggtgatgaggataatcatcgagccatattcttgaatcagttccattatttaagtcctctttcgattatgaacgagctaacattaactcaatgcgtgaaccgatacgttgtgcttgatctgcaagaactccgacccattcgataattttgtataagaacataatgtcaattggattgtattgttgttcaatcgctaacattgctcggcgtagtacgatttgaagttgatccgtatcgtcttcgataacatctaactctaaaatcatattgttcacaaaatttaattcgcgaccgcggaagcctgtttcaagtaggtgatccatttcattaattactttatcaacgtgaactgttgcatcaaggctacgggttaagaattgttggaaaacaggttggatttcttcaggaatgtttaattgacgaccgattgcacgaccagaaatatctttagcatagtttgctaatttatctaactgtgtaacgagttcaagtaagtcagtacgttcaacaggcataaataaaccacgcggtgattttaaacgaatttcacgtttaagggtatctgcgcggttttctaaatcaatgacttgacgacggatatcttccgctacttcccaatttttttgaaaactcgcttcaaaaaatgggattagtaatccacaacattcagtcactttttttgagtgcttttgtaatggcttgagtggcgactgtgcgaataatcctaaaatattattctttgccataggtatatctccaataaaatttaacagcgttgatttgcacttttgcaaatcggtgtaaattttaccgtatgttttcaagaagatcacggattaatgtttaacaagcggtaatatttggtgtttttttagcaaaaatggtaaaataatcacagtgtttatctttgatagctgttacaaatcaaaatgttacccccacaaaatcctcacttttaaatttacaatatcgcttagaagtattattattcaaggcgttttgcctatgaatgaggcattcagtttatttatgttgaaattgattagagggtaggtatgcaaaacctagaaaatatcgttgctgaagcgttgcaagcggttgaaaaagccagtgatgttgcaagtcttgaagcattgcgtgttgaatattttggtaagaaaggtcattttaccttgttaatgcaaggcttgcgtgatgtgccagcagatgaacgtcctgcggtgggtgcaaaaattaatgaagcaaaacagaaagcacaagatgcgttaaatgggaaaaaagagcagttagaaacagaagagctcaatgctaaattagccagtgagagtattgatgtgagcttacctggtcgtaaaacagagttaggtggtttgcaccctgtgtcgattacaattgaacgtgtggtgaaattcttctcagaacttggctttagtgtagagaaaggtcctgaaattgaaacggattattataactttgatgcgttaaatatccctgcacatcaccctgctcgtgcagatcacgatactttctggtttgatgcagagcgtttgttgcgtacacaaacatcaggcgttcaaattcgtacgatggaaaaaatgcaaccgcctattcgcattatggcgccagggcgcgtttatcgtaacgactacgatcaaacccatacgccgatgttccatcaaattgaattgctttatgtagataaaaaagcgaactttactgagttaaaaggcttattgcacgatttcttaagagctttctttgaagaagatctgcaagtgcgtttccgtccgtcttatttcccatttacagagccgtcggcagaggtggacgtaatgggtaaaaacggtaaatggcttgaagtgttaggttgcggaatggttcacccgaatgtacttcgcaatgtgggcattgatcctgatgaatacactggttttgcggttggaatgggcgttgagcgtttgacgatgttgcgttataacgtgaccgatttacgttcattctttgaaaatgatctgcgtttcttaaagcagtttaagtaatctaatcattttgcggatatatgcagtttgcggacacacgcagtgtgtccctactatattaatggcttattttctcttgtagggacacactgcgtgtgtctatcataacaagtggtaaaatttgtagaaaacgttacaaatataggatagaaataatgaaattcagcgaaagttggttgcgtgagtgggttaatccagcgattaccaccgaacagctatgtgaccaaattactatgttaggtttagaagttgatgccgttgaagcggttgcaggtgaatttaacggtgttgtgatcggcgaagtggttgagtgcgctcagcaccctgatgccgataaattgcgtgtcaccaaagtgaatgtgggtggcgaacgtttattagacattgtttgtggcgcaccaaactgccgtcaaggtttgaaagtggcttgtgcaacagaaggggctgtgttaccaggtgattttaaaattaagaaaactaaattgcgtggtcagccatcagagggaatgctttgttcattctcagaattagggattaaagaagatcatagcggtattattgagttacctgcggacgcaccagtgggtttagatgtccgtgactatctcaaattaaacgaccgtgcgattgaaatcagcttaacgcctaaccgtgcagactgtttaagcattgcaggaattgcgcgtgaagttggggttgttaatcaattagcggtgaatgcacctgaaattcaagctgtgcctgcaactattgcagataaagtgacgattgaacttcaagcccctgaagcttgcccacgctatttaggtcgtgtggtgaaaaatgtgaatgtcaaagcacagtcaccattatggttgcaagaaaaattacgccgttgtggtatccgttctatcgatccgattgtggatattaccaatctgagcttactggaacttggtcagccaatgcacgcttttgatgcagcaaaaatcaatggtgcaattcaagtgcgtatggcaaaagagggtgaagaactcgtattgcttgatggcacgacggcaaaacttcagccaaatacgttgttaattgcagaccaaaacggaccgcttgcaatggcgggtatttttggtggtgaagcgagtggcgtaagtgctgaaaccaaagatgtggtgttagaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcttcgcaccgcttgcaattacaggtcgtgcaagacaatatggcttacacacagacgcatctcaccgttttgaacgtggcgttgatccagaattaacgcgtaaagcaatggaaagagcgacagcgttactgcttgaaatttgtggcggtgaagctggtgaaatcgtagaagcggtaagttcggctcatttaccaacgtcaaaacaagtggttttacgtcgtagtaaattagatagcttactcggccatcatattgaaacagaaaccgtaaccgatattttagctcgcttaggcttaaacccaagctatgcagacgagagctggacagttcaatcaccaagctggcgttttgatattgagatcgaagaagatcttgtggaagaagtggctcgtatttacggctataacagcattccaaataacgcaccgcttgctcatttacagatgaaaggcttcccagagaagattttagaagctattcgtgtgagaacggctttggtcgatagcgattatcaagaagtgattacttatagctttgttgatccaaaagtgcaagagctgttacatccaagccaagaagcgttaattctaccaaatccgatttcaagtgaaatgtcggcaatgcgtgtgtcgcttttaacaggcttacttgaaaccgttgcttataaccaaaaccgccagcaaaatcgagtgcgtatttttgaaagtggtttacgctttattccagatgccaatgcagaaaatggcgtacgccaagaatttgtcttaggtgcagtgattgtgggtgataaacgactggcacattgggagcataaagcagaaaacgtcgatttctttgatctaaaaggggatttagagcgtgttttatcgctaacaaatgctggcaatcgtttacgttttgttgcaaaatcatatcctgcgttccacccaggacaatctgctgctattttactcgacgatcaagagatcggttatatcggcacaattcaccctaaagttgttcaaaaactcggattgtcaggtaaacctgttgcttttgaattattgtggtctgcgattgcagagcgttcagtaccaaatgcaaaagaaatttcacatttccctgcaaataaacgtgatattgccgtggttgtggatagcaatgtacctgcaggtgatctacttgatgtggctcgacaagcaggtggcgctaaacttgtggcagtgaatttatttgatgtttaccaaggtacaaatttacctgaaggtaagaaaagtttggcgatcagcttaacgattcaagacactgaaaaaactcttgaagaggaagaaattaatgcggtgcttcaagctgttctcgaaacacttgcacaacgttttaatacttatctaagagattagattttaaggataaattatggcacttaccaaaattgaaatcgcagaaaaccttgtcgaaagatgtggtttagataaacgtatcgcaaaacaatttgttgaggacttttttgaagaaattcgtcgctcgttagagagcggtgaagaggtaaaactgtcgggcttcggcaattttactgttcgtgataaaaaagctcgtccaggtcgtaatcctaaaaccggcgaagatgttgcagtgtctgctcgtcgagttgtggtttttaaagctggacaaaaattgcgtgaacgtgtcgaaaatgcgaaggtaaaagcctaaatgattattctgcgaaatcttggtatttcgcagaatatttttaaggatcaaaatgttctatcaattaataaaaaagcatttttctttatgcacaatgttgctttgtgcatttttattgtccgcttgtgtatcaaaaaccagtacagttcaagataaaagcggaaataaacataaagggcagctttcagactccatttttgtgattagcagtttaagcgaacatcaaagagagtggaaaggtacacgctaccgtctaggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccgtctaggcggtataacaaaaagcggtattgattgctctggttttgtgcaacttactttccgagagttatttggtattgatttacctcgaataacagtagatcaagcaaaagcaggcatacaaatctcaaagagtgaattacgtacgggtgatcttgtcttttttaaaactggtcgtgggccaaatggcagacatgttggcatttacgtcaaaaatgggcagtttcttcacgcttcaacaaaaggtggggtaatttattcagatattaattcaccttattggtctagaagtttttggcaagcaagaagattgtaagcctacatttaattagatgtaattcatgtttactatacatttgtttaaatgaatactgaactgacatgaagcatgaatactactaaaattagtacaggctccaaaattcggtaattatcttcaaaagattacggattttgcgatataattccctaaattctccagttgtgtgttcaaggatttaattatgtcaaacaccactcaaaaggaatcttgtattgttattgcaattgcaggggcttcagcttctggtaaaagtcttattgcttcgactatttacaaagaattgcaagcggaattggggcaagatgatattggtattatttctgaagacgcttattaccgagatcaaagccatcttgcaatggaagaacgggtaaaaaccaattacgaccacccaaactcaatggatcacgaactgttagttacccatcttaaaagcctcaaacaagggcaagctgttgatattccagaatatgattatgcagaacataatcgcaaagaaaccgtaacccacttcactcctaaaaaaatcatcattcttgaaggtattttattacttactgatgaaaaaattcgtgatgaaattaatgtgtctattttcgttgatgcccctttagatatctgttttatccgtcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatggaggagcgtggcagaacaatggaatctatcgtaaatcagtatcgtaaaacggttcgcccaatgttcttacaatttgttgaaccatctaaacagtatgcggatattattattccaaaaggcggtaaaaaccgtattgcgattaatatcttgaaagcacaaattaaacagctattaggacatagttaatatattagggggaattatgcgtttatgtgacaaagatattgaacgttatcttgatgaagggattatcagcctaacgcctcgcccatcaaatgaaaaaatcagtggagcgacgattgatgtccgtttgggtaattctttccgtgtgtttcgtgaacattcaacgccttatattgatttaagcggcccacgtgaagaaatgacggcacagcttaatcgtgtaatgagtgatgaaatcctgattgccgatgatgaagcctttttcctacaccctggggaactggctttagcaacaacgcttgaatcagtgaaactacctgccaacatagtcggctggcttgatggtcgttcttctttggctcgacttgggttaatggtacacgttactgcccatcgtatcgatccaggttgggaaggcaaaatcgtacttgagttttttaatgcgggaaagttaccgcttgcattacgtcctaatatggcaattggtgcattgagctttgaaattttaagtggttacgcagaacatccatataatgctcgtaaagatgcaaaatataaaaatcagcaaagtgcggtgtttagccgaatcgataaagatgaataatcataattaacttccctacgaaaaatgcctttagtcgtcaaatactaaaggcattttgtctactatgccgcctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctatgcctcattcttgattattcattatgaatttccaaattacctgcctgcttcgcttgggcggttttggctttatcattgcgcgcttgagctatcgcatttaagtattcgcaactcacatcgcctgttatatattccccagtgaaaacagaagcgtcaaagttgtgaatatctggattttctaactgaacagacttaaagagcgccgataagtcttggaaaatcaggcgatctacaccaatcatttcagcaacttgttccacgctacgattataagcaaccagttcttcacaggttggcatatcaataccatatacatttggataacgtacttcaggggcagctgaggcaaaatagactttatttgcccccgcttgtcgagccatttcaacaatctgctctgaggtagtgccacgaacaattgaatcatcaacaagtaatacattttttcctttaaattcagaggcaatggcattcaacttgcgacggactgaattttttcgttgtgcctgccccggcataataaaggttcgagcaacgtagcgatttttcacaaacccttggcgataagtttttttcagtactgttgcaatttgtaaggcaatatcggtagaagtttcaggaatcgggataaccacatcaatatccgccagaatatctgtccactctttcgcaattttttcgcctaagaatttccccatatgtactcttgctgcgtaaacagatacgccatcaataacagaatctggtcgagcgaaatagacatattcaaagatacaagggttcaatttcgggttatcggcacagattgctgagtagaattgtccatcaaaggtaatataaatggcttcgcctgcttgtacatctcgaacatattcaaatccaacaacatcaagtgcaacactttctgaagcaaacatatattctgttttgccgtcaatttctcgtttgccaagtacaagcggtcggataccgagtggatcgcgaaatgccaccattccgtgtccgataatcattgataaacaagcataagccccacgaatcacttggttagttttgcgaacgctttcaaaaatattttcaggcgttaggagttcgtgtggatattgatcgagatagtaagcaaatatattgagtaaagattctgaatctgagtttgtattaacgtggcgtttggctaggttgaacagtaggcgttttaactctgcattgttggtgagattgccgttatgtactagggttaaaccataaggggaatttacataaaacggttgtgcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatacacttgagctacctgcagttggataacggacgtgtcctataccaacatttccctgcaaacgtaacatatgttcttgacgaaacacatcactgactaagccatttgctttacgcaggcggaagcggttttcatcgtcaatagtgacaatccctgccgcatcttgccccctatgttgtaataacgtaagtccgtcatataacgcctgatttacaggggtttgaccgataatcccaacaatgccgcacataattacctcttaaattagctagattttaaaaaactggaatttgcttgtaactgttcaaagaaccacttcacaatgaaatcaaagtgtggaataagttgtgattccttccataattcgctttggctaaatgccgtaaaggtatcaaggaaaaagagtatcgctgcgacaataaaaatgcctcttaatataccaaaaccagcacccagtacacggtctgtaccgcttaaacctgttttatcaacaagttggctgagtaatgcgttaatcactgcactgatgataagcacggcaataaataaaatcgcaatcgcaataccattacgcaaatattcggaattttggatgtagacagagttgatttgtaataagtaattacttaaataaggataaaaatggctagaaaccaaaaaagctactatccaccccacaagcgcaaagacttcactaataaagcctcgccatacactgactaataaagaaaaaacgataattccgataataatcgcatcaaccataaatacctcaatattgcctttcggcaaaacggaaactattctacaaaaaaaagaaaacgtttgcgtagtccatttttcaacacttgttgaaaaaaaatagcatacatcaaacaatataatgtgctcccaaactcactttcctactcagcatcgcctttaccacactttgtgcggctttgagagcgtggtaaatttcaataccttgataggcttgatattcaagggggcaataacgttgctctaactgcgttaagcagttcaacagttgaaccaaattcgcctctgttcgataaacattagcgtatgttgccatctgagaacgaatggtgcttaacacctcacttgccgtcagcattttatcaccctttggatttgctaacgactggaaaaactgttcaatactacgttcacacgctatatcgttggtaagcggtcggttttccgctaaattttgcaaaatccgttggattgctcgtttagcaaaaaccaaactacctccgacagaattgccacctaaacggttcgccccttcaatgcaagaagaaacttcgcctacggcaaaaagccctttcacttcactttcggcaaattcatcgatcacaataccgccgttacaactgtgagcaaatggcgtaatcgcaaccctatctcgcacaagattaatcccgacttctttctctaaccagcttaaatacacggtgtaaaattccgtttgatcctgatacagctcaggggaatagtgcagataaatgcctttttcttctgggtgttcgagcaagtgcttcatcatcaccaaatcaaactcaacgcaagggaaatcaatactaaaaggggcataatcactgcgagcagtcatcatctgttgaaactgctgtggtgaaaggtgtggaaacagatctcgcccttggctgtcagtcactttactgacatattttaaggtatgctctccaaacagcactttgtatttaggctcaacaaaagcagggataaactgaataaattctaagttagtcagccttgcccctgcttgttcagcaatggcatgggttgaaccaatcacatcggctggatagaggttatctttatacaaccctgcaattccccctgttgccaaaataatttggctggttttgcaaagcacatagcggatctcaccgcttgttttataggaaaacaacgccccttgaacttgctgattatcgctgacaatatgtaacagcgttgcatcttcatagaccgtcgtcccctgttctttgataatctgccttgctctttccgctgcttctcgccactgattaatcaaataaatcgggcgtggatatttcgcaaagcaagcggggcgattgtcattccgtttccaaggtttaaagccaatacgttctaatagctcaatcgcctgtggcgaatcttcaatataggcttgcacaattttcgggttattcattccctgtgcaacacgctcaatatcttcttgaaagcgtgctttatcctgttgctcgccagttacttgaataccaagtgttgcttttaacggaaaaaaacttgcaccactgccgataggggctttggtaattaatgtcgcttgaataccctgagccttagcttcagcacagcacgcaagccctgcgataccaccaccgacaatgagaagatcggtttgtaaataaatataagtttgtttcatttaaatacaggagaattatgtggaagtcccctaccaactaaatcaatatattacgataaaatagagagataaaatccaccatatattttaagtaatgtaccaccatttcatctaggcggaacacctctgaaccaatttgtaaaaaagaaaagatatatactgtttaagtcttaattattcactacgccaaatcagcgttgccattcgtcctgtgactttgtctctacggtaagagaaaaattgttctgcatcgcaataggtacaataatccccccctgcaatttccgtaattccaagtttatttaagcgttggcgagcaatctggtaaagattacctaggaacttaccgcttatatattcatatgccacaaaggcttctctcgcttgtggatcaaaggcacagaattgttctatcacatcttcgccaacttggaatgcggttggaccgattgcaggaccaagccagacacaaatattctctggctcacattcaaattctgccaccgtagcttcaagcacaccatcgcataagccacgccaacctgcgtgggctgccgcaatttctttgccatctttactgcaaaaaagcactggcaaacaatctgcggtcatcactaaacagacttggtttgcttggttggtataaactgcatccgcttcaatgtcgttttgttcatagggcagacgtagcactcttgtactatgggtttgcgttaaatagagcggaaaatgtggcaaattgccttgttcttgcaagatttcacggttagtttgcactgattgtagatcatcggtgacgtgatcacccaaattcaagctatcaaagggagcttggcttaccccaccttctcgagtagtggtgaatgcgtgaacgaaatcaggaacagaccaagttggtagaatttttttcatcgcttattttctcacggcaatcgcttcaatctcaatgccaacatcttttggtaaacgtgcaacttcgacacaagaacgagcagggaaatttgggtgatggttttcacggaaaaatgcttcatattcggcatttaccgtagcaaaatcattgagatctttcacaaatacggtggtttttacaatatctgccacagataaacccgcttgttcaatgattgctttcacattttcaagggattgacgagcttgagctttgatctctgtagggacttcgcctgtttgtggattaaccggaatttgccctgatgttagcactaaattgcctaaatcaaccgcttgtacataaggcccgattgcttttggggcattttcagtatgaataacagttgtcataaaaatctcctagtgaaataaattaaattcaacattgcgagtttgaaagtttttttgtggtttgtaaaggtgatttttattgaagattactactgtttcacttaaaattcgtactactttaatctgtacaaataggatatttattatgccacaaattgcaaatgcccttaacgatagaatgtctattcgcattagtacggaagacaagcagactttaattagagccgttgcacttacccatacgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattacggaatttgtattacaacgtattttgcctagtgccagagaaattattcagcagtatgataatcggcaattttcaccgcaagatctctcgttgattatggaattgcttgataatccgccgaaagctaatacaaaactacaacaagcggcgaaattagcaaaggaaagctatcatgaagagtaagtttattgaagagcctttaacgaagcatcatcaacgtgaagcctttgattgcggaaatctagagatgaaccgattttttaaacaatactctcggcaatctcacgaaaaagggacatcaaaaacttacattagccgacacttagacagtcaacagattatcggattttatacaatcaccttaagtgcattagaccagcaacacttacccgaactatgcaaaaaacgttttgactactaccctattccgctctttacattagcaagacttgcagtggatattcgctatcaaaaacaaggcattggcggaatgctgttagttaaagctctcaaacgctgtgccatcgttgccgaacaagtcgggggaattgggcttctcattgaagcaaaagatgaagacatttctcgttggtatcaatcttatggtgctattccattggaaaatatgccattaaccttaattctactctttgatacaatcaaaggactttaactttttacctataatcgagaataatttatgagcattaacgttaccgaaattgttttacaccaacttcaacaaaccgcaggggaaactgctgagcttcatacggttttacgtgaagatctgcttgcgatcagccctgaagttgagcagatgatgttgcaactacatcaagcctatcaaaataaagcgaaagcctatggcatatttcaatcggaatccatttttgcacaacaattaaaccgcttgttagaaggcgaaagcgaatttctgccttttagccacagttgtgccaaaatgttagcgacagaattagtcaaatatccttttgcttcaggcggaacttttatcctttgccgttatacctttttagcgacggaatatctctttattgcattaattgatagccgtgcgtctatgttggttgatgataagctggaagtgaaacgcacggaatatctcgatattacacaatatgatattgcttgccgtatcaaccttaccgaactcaaacacaacgcacaatctaaccgctatttgacctttattaaagggcgtgttgggcgtaaagttgccgacttctttatggactttttaggggctgaagaaaggttaaatccgcaagtgcaaaatcaaacgttgcttcaagcggtgagtgattattgtgaacaaggcgagttagatagtaaccaaactcaagcggttaaaaaacaggtgtttgagtactgtaaagggcaaatcaatagtggggaagaaattgcgatcagcgaattatcagcttcaatgccaaccttaaaagagattgattttgctgactttgccgagcaacaagaatatggcttagaagaaactattccacctgtgcgtaatgcgttaaaaaccttaaccaaatactcaggttcaggaaaaggggtgacgatcagttttgatgcggaattattatcccaacgtattatttgggatgaactaaatgatactttgacaatcaaaggattacctgcgaatttacgagatcaattagaacgtaataaataatgacattttatcggcgatttcggtataatcgccaaaaattttaagaggaaggttatcgctatgaaaatgaaatcgcttgttgctgtattattacttgccttaggtgttactgcttgctctacgataaaaaaagtcgtttatcgtattgatgtgccacaaggtaactatttagagcaagaaaaaatcgatcaactgcaagttggtatgaataaagagcaggttcaatatctgcttggaacacctatgctacgagattcctttgctcaagatcgttgggattatgtgttcattttgcgtaaaggctatgaagatcctatccaaagaactatctttgtttactttgataataaaggcttagtgagcaatattgctctagataacgccactgcacagtgatacggaaattagagcaaaacaacatagtattatctcatagcaatttaataatcgtgcctaacgtctattggctaatcagaactcaaacataaatacatgaatttttatcctctattattgagctgaaagcagtattttatttttataattacctatggtttctcaaaattacctcggcgtaatgtctggcacgagccttgatggcgttgatttggcgttagtcgattttagccaaacgcccaaattaattgctgccgacttcaccccaatgcccgacacacttcgtgttgccctgtcgcagttagtcaaaaaaggggaaacaagcctacaagcattaggcgaactcgatcaccaattagccttgctctatgctgacagtattcagcgttttttagctaaacatcaactcaatgctgatgatattgtggcggtgggctgtcacgggcaaaccgtttggcattcaccaaaagggcaatatccttttacaatgcaaattggcgatatgaatttattggcggctagaacaggtataactactgttggcgattttcgccgtcgggatatggcttttggcggacaaggtgcgccgctggttcctgcctttcatcaagcggtgtttagttcccctgaacgcctaaccgttgtgctaaatatcggcgggatcagcaatatttccgtgcttaatcctaaccagcagactatcggctatgatgtcggggcgggcaataccttattagatatttggatcgaaaaacatctcggcaagcggtatgatgcgaacggcgaatgggcaaggacagggaaaattcattccgctttacttgcattgctgttagacgaaccctttttccaactgtcaccgccgaaaagcacagggcgagagctgtttaacttggaatggttggaacataaattaacccaaattaaaccgcttcctgctgaagatgtacaggcaacgctggttgaatttaccgtacaaagcatagtgcaagccttacggcaaattgaaaatccgcaggcttatccctgtgttttattggtatgcggcggcggagcgaaaaatccattgataatggaacggttacaaacccatttaaccgattggcaggtctccactacaacggaatacggcttagatgtcgattatgtggaagcggcagcatttgcgtggcttgcgtatcaaaggatacacaatctgcctgcgaatttgcctagcgtcacaggggcgacacaagcggtcagtttaggggcaatttttcccaacatataaaaggagtaacaatggcagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggagtaacaatggcagaacaagatcttctaaaaaccttagggcaattaattaccgaacagcgtaatccaaacagtatgcagattgatacactttctgcctatgaaattgtacaaatcatcaacaatgaagataaacaagtaccattggcgatcgaaaaagtattgcctcagattgcccaagccgttgagaaaattgtcgaagcctttcagcagggcgggcggctagtctatatcggcgctggcacaagcggacgacttggcgtgctagatgcgtcggaatgtccgccaacgtttggggtgtcacctgaaatggtcaaaggcattattgctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgagcgtgccttgcgacacccaatcgaaggagcggaagataacaaagaagcgggtaaacaagatctgcaagcggtcgaatttagcccaaaagatgtcttggtcggcattgctgccagcggcagaacgccttatgtgttaggcgcgttagcatacgctaaacagcttggtgcaaccacagtgtcgattgccagcaaccctaattctgcaatgagccaaattgccgatattgtgattgatactgtggtgggggcagaagttttgacggggtcgagccgaatgaaatcgggaacagcacaaaaattagtgttaaatatgcttactacggcaagtatgattttaatcggcaaatgctatcaaaatttgatggttgatgtgcaggcaagcaatcaaaaacttgtcgcccgtgctattcggattgtaatgcaagcgactgaatgttcccgtgaaattgcagaaaccaccttagccttagcggagaataatgcgaaattggcaattatgatgatcttggcggatctggataaagatggggcagagcagttgttaagtcaacagcagggaaaaatatctcgatacacaatagtgtagatagaacataatcaatgaattcttaatcatataaaataacaatgaaaacccaagtaaaacaacacctaaccgatctcgaaatcgctttgcgagtacataatctctgggaagcaactccgccttccgcagaagccttagccaatgatgaacctttttgtgttagcacactctctgcaacccaatggttacaatggatcttcttaccaagaatgcacgccctattagaagccaatgccgaattgccacgcaattttgctatttcgccttatctagaagaagccttgaaagatttagattatctccaagccttaaacgctccccttgttaaacttgaaaccttgttgaaaagcgaatgaaactagagattatctatcaagatgatgaacttattgcgataaacaaacctgcaggaatgttggttcatcgaagttggcttgataaacacgaaacagtttttgcaatgcaaactttacgagatcaaatcgggcaacacgtttttctgatccatcgtttagatcgaccgacttctggcgtgcttctttttgccttaaatagcgaaatggcacggacgataagccagctttttaaacaacatcaaatacaaaaaagctatttagccgttgttcgaggttatctacaaggggaagggcggattgattatcctcttaaagtgcaactcgacaaaattgcggataaattttcccaagaaaaagaggcacaagaagcgattaccgattatcgaaacattgctaccgttgaaatgccctaccctgcaggaaaatttgcaaccgcacgttatagtctggtacaactctaccccaaaacaggcaggaaacatcagcttcgtcgtcacttaaaacatctgttccacccaattatgggcgacaccaattacggagacctgcatcaaaaccgagtattaacagcaaacacaggctgtgatagacttatgctccattccaatagtttgcaatttattcacccgaaaaccttgcaaacaattgagataaaagcaccgcttgacgaacagtggaaagcactttttacgcaatttggttggaactttactaaattttattagacttatcatggttctatatggataatacactactgagtttaactcacgaacagcaacaacaagccgttcaacaaattcaacaacttatgcaacaaggtatcagcagcggcgaagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtaaagattgccccagagccccctatgatggtgctcactacaattgactttagtggggaagtccctaagtcactaaatagcacaacatactctatcagtaataaaaaaattcaattatgctgggaagtaatcaatgtaccttttactgctcaaaataaaacgactgaaatatttaatagcccagcaaaatctacaatgatgggggggcaaggcgataatgtagtatcaacaaaagatggaaaaatgcatactattacaagccaaatgaaaagtgtaaataacgaattcattcgtcgttgttggaaatttgataacacggatccaattggcgactatacattagatctacaaattaatgatacaatattcccaacacaaaaattcaaaattgtgaaataacccttataggttacttcttctgctcttccgctcgtttacgtctaatctctttaggatcggcgattaacgggcggtagatctcaatgcgatcgccattttccaccatatctgttaatttcgcaggacgactaaaaacacccactttattttctcgtaagtcaatttccgtatgtttttgcaatacgcccgattgcaaaatcacattttgaatggaaagtggattgtctaattccattttcttataaaaatatttttcaggataagcgtaaatcacttccaccacaattttttgcgtatcagacaccatacacctcttttgctcgctgtttaaacgcattcaccattttgagcgttaattcattgaaaattttgccaaacaccataccaatcatcgggcttgaaaattcaaattctaaatttaggctgattttgcaactctgttcatcaaacgactgaaaagtccaagctccatgtaaatacttgaacggcccatttaataattccattgtgattttttcatttggtatcatcgtattatgggtgctaaaacgttggctaatccccaatttttgaatgactaattctgcattgagttcattgtcgcctaaacttaaggtcgttgcctcaacacagcctgataaaaactgcggatatttttcatagtcattgactaaacgatacatctgttcagcactataaggcacaagagaggattgattgacagttggcatagtatttttaagtaactaaaaaatggcgatagtttaccacaattttgtatcaaccaatggaaagcaaattaaaagaaaaaaattgttgagcaaactctaccttaatttttcaatgttattagcagccttttgtaacaaaggtgttttgaataacattactatactctctttatgaaatatggtttgaacactgatgctacgaaagaaattaaatatttctgtaactactgcataatgctggtttaattaataacgccaccgcttcacaagcaatgccttcgccacgtccggtaaagcctaatttttctgtggttgtggctttgacattgacgcaagaaatatcgcagttgagatcgtcggcgatcacttgacgcatttggtcaatataaggtcgcattttcggggcttgagcgataattgtcacatcaacattccctaccacataacccgttgcttgaacttggcggtaggcttcaatcaataatttacggctgtcagcatttttgtattgcatatccgtgtcaggaaagagcttaccaatatccccaagagcagcagcgccaagcagagcatcggttaaagcgtgtagagcaacatcaccgtcactgtgggcgataaagcctgtatgatagggaacggcaacaccgcaaatcattaatggacgatcttgtccaaaagcgtgaacatcaaaaccgtgtccaattctaatcatcttattatcctcttgttagataaaattctgcgagagctaaatcttcaggacgagtgactttaaggttatcgctacgcccattaattaataacgggtggaagcctgcaaattccatcgcagaagcctcgtcagtgatggttaagccttgcttaaaagccgattgtaaagcctctttgagcgatttcgctggaaagaactgtggcgttaaggcgtgccatagggttgaacgatcttccgtatgagcaatctgcgagccattagcccgtttcatcgtatcaattgcaggggttgctaaaattgccccttgattatcttcaatccgcaaaagtttgtctaaatctgaccgcttaaggcaagggcgagcagcatcgtgcactaatgcccaagcggtttcatctgtgatagcattgagagcattaaaaaccgaatttgcgcgtgtttctcccccaagcacaatctggattttgtcggatttaagcagagcaatatcgccataatagcgatcctctttagataccgccacaataatttggctaatcgcagggtgttcaagaaaaggttgtagcgcatgttccaacagcgttttacccagcaaggtcaaatactgcttaggcacagccacattcattcgactacctacgccagaagcaggaatgatcgcaatgatttttctcttgctattcattaacgttgctctcttgggacgatgcgataaaacgtttcatctggtttaaccatttcacgatcaagccttgctcgttcttcaagggcattgatacccgtttttaaatcttcgatttcggcttgaataagttgattacgaacggtcagtttctgattagtttctttcagttgagtgacttcttgtttagtccgttggtattcattccaaccgttttgcccaaaccaaaaagcatattggaaaccacctaataaaagtgctaaaacgacaattaaaactcgcattcttttaccccattcaataaaaaagatgaactattctaccccgaattacaaaaaatataatctagatcaaaaaaattttttatcaattctcaaaaatttgaagtatgtaacattttttttggataattactctataatctctccagtttttaaattttaatctttaatcatatatgaggtgaatttatgttaaatcgtgttgaacaagaacttgcacttttaggcattacaaacgttaaagagattgtttataacccaagttatgaacaactctttgaagaagagatgaaacctgagttagaaggttttgaaaaaggacgtttaacgacttcaggtgcggtcgctgttgatacagggattttcacaggtcgctcaccaaaagataaattcatcgtattagatgaaaataccaaagataccgtttggtggacaagcgacgaagtgaaaaacgataacaaaccaatgagccaatcaacttggcaaagtatcaaagaacttgttaccaaccaattatcaaataaacgtctatttgttattgacgcattctgcggtgcgaacaaagacagccgtgttgcagtgcgtattgtaacagaagttgcgtggcaagcacactttgtaaaaaatatgtttatccgtccatcagaggctgaattagcgaacttcacaccagatttcgtggtaatgaatggttcaaaagtaactaacccgaactggaaagagcaaggcttaaattctgaaaatttcgtagcattcaacattactgagaaaatccaattaatcggcggtacttggtacggcggtgaaatgaaaaaaggtttgttctcattgatgaactactggttaccattaaaaggcattgcatcaatgcactgttctgcaaacgtgggtgaagatggcgatgtagcggtattcttcggtttatcaggtacaggtaaaaccacattatcaaccgatccaaaacgtaaattaatcggtgacgatgaacacggttgggacgacgatagcgtattcaactacgaaggtggttgctatgcgaaaactattaacctttcagaagaaaacgagcctgacatctatcgtgcgattaaacgtgacgcattattagaaaacgttgtagttcgtgaagatggttcaatcgatttcgcagatggttcaaaaacagaaaacactcgtgtttcttacccaatttatcacattgataacattgttgagccagtatcaaaagcaggtcacgcaacgaaagtaatcttcttaactgctgacgcattcggcgtattaccaccagtatctaaattaactccagagcaaaccaaatactacttcttatctggtttcacagcgaaattagcaggtacagagcgtggcgtaactgagccaaccccaacattctcagcctgtttcggtaaagcattcttatcattacacccaacacaatacgcagaagtgttagtaaaacgtatggaagcatcaggtgcagaagcatacttagtgaatacaggttggaacggtactggtaaacgtatctcaattaaagatactcgtggtatcattgatgcgattttagatggttctatcgaaaaagcagaaatgggttcattaccaatcttcaatttagcaattccaaaagcattacctggtgttgatcctgcgatcttagaccctcgtgatacctatgcagataaagctcaatggcaagcgaaagcggaagatctagcgggtcgtttcgtgaaaaactttgagcaatatgcaaccaacgatgaaggtaaagcattaattgcagcaggtccaaaactatagctgctttatacgtaggagttaatatcctatgttataaaaaatgaatgtaaaagggctggtgatggtatttcctgactcagccctggtttatttcgatgtaatagataaacctgatacagtaaacaataacaatcggcatagtagacaaaaaattagcggtaattagaaaaataattttaaaaccaacactttttgtctactatgccaattatttactctactacttactataagaggaagattattagaattatatagccatttttaaatccaaacattcaacttttccaaattcctcttgaagtactcccaccctgtaaaatattccattgcttgctgaggatatagcgtcgctaatttttcggctaatttcggcgattgcattagtcgccaaaagtccaccaactgttgctctaactgataacgggctttttctgataattgtgctatatcacaagcggtaagtttatcgatctcttttgcaatctgctcaggctgtccgaccaaatagcctcgctgggctttactcaagctactaaaccacattccatcttgtttaggcaatgtgtctaaaaatgcaattaaatccgctagcattccctgttttaattcaaactccacttcacaaatggcttcttccccaaaaggatttttcactttgccttgatcgagagcaatttcaatttgagccgtcggcgttgtaatcaaccatttctctcgcacaaaatcggtgctaaaggttggttgtaattgactgtctaataaatctgcttgcggaaagggtaaattaaagtgagaaactaaccgcttaaaatctggctgagcatcaggcaatgctagattatattcagggcgaatatgcaatccacctacaatttcgcctttcattttaagggttaattcatattgctgattttgatgacgaacccgtaatcccattttgttgttcgcaaaaaagagatcggggctatcataataggtatttcctaacagctcttttccttgttctaagataggttgagcatttatccactgctttagcatcggcacattttcaggcagtagcattatttttagttcgatttcgttttccataggcatattaaaaaatagaggggcgtttaaaacgccccttcgagtgataaaaagttactgattattttgaggttgtgcttgtggctgtaatggcacttgaatggaagagttttgtgctttttgtttctcatcttccgttaaagtcacatttcctgcactagtacgacgttgtaactcgtgattttgcaacagcacattaatacggcgttgctgatactccaactgttcagctgtcggctgatctttggctggcgcattatagcttacttgctgtacagaatttgagaaaggcaaggtttgcaatacaggttgctccgcttgagccacttcctcactgctgttcatcatattcacaccccaaacggctaccaagcagacagaagctgcaatccccgcctgcattaacggtgttgcccagcgtttcaatttgagtaacatacctcttggtttctcactttgttgagcttcagccaccgcctcaatctcctcattttcgagcaacgcagccatttttgcagagaaatcactacccaaaatctgctcttcacttcgcatcacgctacgaatagtatggtagttcgcccacgttttttgtaactcagcactattgcataaagtttcagcgaaatcaccgctttctttatgtccgtccatataggcggaaagtgtttctttatgttgcatagataactccaaagtattttaattctgctacaaaagcggattgattttggcatcaatcgcttcccttgctctaaaaattcgggaacgaaccgtacccacaggacattgcattgtttctgcaatttcttcataactcagcccttcaagctcacgcaacgtaattgccgttttaagctcatcaggtaggttttcaattgtgtcaaacacgacacgttttaattcttcagacaacaccaaattttctggtgtatcagcctcacgcaactgcaccccaccatcataaacttctgcatcttcagctaaaatatcttctttcggtggtcgtctgcctaaggcggttaaatggttttttgccgtatttacagcaattcgataaagccaagtataaaaagcactctccccacggaaagcatttaatgaacgataggctttaataaaagtttcttgcacaatatctggaatatcgtctcttgcgatatagcgagtaagcaacccagctactctattttggtaacgcacgacgagtaaattaaacgctttcttatcaccattttgtgcacgctcaaccaattcttgatcggctctttgctcactcatcgttttgcgttctcctaacttctacgctgtttttatttttcttgaatgcacgcttgttagtgtgcgatatttctttaaagttcataaaaatagtttgattaattaaaatttgtgctaaatttgcaaaaataataaacatatcttcctatactaaaaaacaatatgcctatattcagtataataacgttcagttgtaaataataccctattttagtggagttttaaaatgataatcagtattcagcaacgtgcagaacttcaacgccgtatttggcagatcgctaatgaagtaagaggttctgtagatggttgggattttaaacaatatgtattaggcacacttttctatcgttttatcagtgaaaactttaaggcttatattgaacaaggcgatgaaagtgttaattacgctcagttttcagatgacgatcctattttagaacaaatcaaagacgatacgatcaaaagtaaaggttactttatttatcccagccaactgtttgagaatgttgttaaagatgcacacaccaatcctacattgaatatagaattggcagagatttttgcagatattgaaaattcagcgaacggttatccgtctgagcaagatattaaaggcttatttgctgattttgacacacgaagtaaccgcctaggtaataccgttgccgataaaaataaacgtttgactgctgtattaaaaggggtggaagaacttgattttgggaaatttgaagataatcacattgatcttttcggcgatgcctacgaatttttaatttcaaattatgctgctaatgcgggaaaatctggaggggagttttttacgccacaaaatgtttccaaacttattgctcagctggcattacacggacaaaaaaccgttaataaaatttatgaccctgcagcaggctctggctcattactactacaagcaaaaaagcaatttgatgatcatgtcattgaagatggctttttcgggcaagaaattaaccataccacatacaaccttgctcgtatgaacatgtttttacacaacatcaactacgataaatttgatattgctctcggcaatacactgctcgacccacaatttcaaaacgataaaccatttgatgcaatcgtatccaatccaccttactctattcgttggattggtgatgaagatccgacattgataaatgatgaacgttttgccccagctggtattctcgcaccgaaatctaaagcagactttgcttttattttgcatgcgttaagctacctctctactcgaggacgtgcagcgattgtaacattccctggtattttctatcgtggtggagcggaacaaaaaattcgtaaataccttgtcgataataactatgtagaaaccgtgatcgctcttgcaccaaatttattttacggcacatcaattgccgtgaatattttagtgctttcaaaacataaaccagataacaaaacccaatttattgatgcaagcagtctatttaagaaagaaacgaataataacgttttaacggatgagcatattgctgaaatcattaaattatttagcgaaaaaactgatgtacctcatcttgctcaatccgttgaaaatcagaaaattgctgaaaacgaatataatctcgccgtaagttcttatgttgaaccaaaagatacacgagaagttatcgacatcacagcactaaatgctgaaattcgcaaaacagttgccaatattgaccgcttgcgtacagaaattgatgctatcatcgcagaaattgaacaataaagcctattctagagtgataaatgaaacaacaaaaaatatggaaaagtttcaatgaccaactggagatactaaaaggtagaggtctgcttgttgacgatgaaaagaaagccttaggctatttaaaaagtattggctattatcgtttaagtggctatttatattctttccgtcaaattgattcacataatactaaaaagcgccttgatcagtttatacccaatagccgctttgaagatgtaaagcagctctatatgtttgataaaaagttaaggcaacttgccctagatgcattggaacggattgaaattgcactaagagtaaatattgcttacacgttaggtcaatatgaccctttggcatatcaaaaatcccaatatgttgacccatgcttcaaccatcaaagttggttgaataaatatcaaagtttaatcgacagggagtctgaaagcagttttgttaaacatcatttagaacattacggcgacttacctatttgggcagcttgtgaagtttgggattttggaacaatgtcgatgttgtataaaggcatgttagagaaagataaagatcacattgcaaaaatttatcatttaaaagatgggaaacatctacaaacccatttgcacgcctttaactttattcgcaatgtatcggctcatcatagccgtttatggaacaaacccattatctttaaagcaaatttaaaagggttaaaggaagcacaatggaagcaatttgatgttgcgaagccttttgtttatttctgtttaatgaaaagaatgttggatgttatctgtccaaattcaacatggggagaacgttttctcgcattattgaatgaatttcctcaaacagaaaatcaagcggtaacgttgcaacaaatgggcatgatttctgatttaacccattgggatttatggaaaaaatcctaaaaaaagaaagcccccaaccttgtggctccaacctcatgggttggcaaagtagggggagttattgaggcgaattatacaactcaggatccaaaggtcaagggttattactaaagtaatgtgataagcggtcagattttagtaaaaatttgcaaaatatagaaaagtaagagatgagctttagctcatcggaaaataaaaggttaaatgatgggctaaagcccatcctacgaggtttaacatgatagaaagtcgttttattgaaaagttgttgaatggtagagaggtggagtggttcgccttagaagacatctttgatttaaaaaatggatatactccttcaaaatccaataaagattattgggagaatggtactattccttggtttagaatggaggatattcgtgaaaatggtcagattctaagttctgccttacaaaaggtttctgttcatgctattaaaggtggaaaattatttccagctaattccattattatagctacgtcggcaacaattggagaacacgccttaataacagtaccatatttagctaatcagagatttacaaacataagcttgaaaaaaaatttcactaatagagttgacagtaagtttatattttattattgcttcttattaagcgattggtgtaaaaaaaatacgacaatttcaaattttgccgcagttgatatggttggctttagaaaatttccattcccaatccctcctattgatgtacaacaagagatagtacggattttggacgcatttacctcgcttacagccgagcttacagccgagcttacttcaagacaaaaacaatatcaatattttagagataaattattgaattttgatgatatttctgatagggggggggtacgagactaactccattaccaaagccttattgcacaataagaaagtggtgtttaaggctttgggggaggttgtaaaaatcaaaaatgggaaagattggaagcaattagaaaaaggaagcattccagtatatggttcaggtggaattatggcatctgttgataccttttcttacgataaacctacagttctaattccaagaaaaggaagtattacaaatattttttatgttgaaacacctttttggaatgtagatactatctattacactgaaattaatattaaagagcttatacctaagtatttttatcactatatgaaaactattgatctagaaaaattagatacgggttcaggaagaccaagtttaactcaagaaatattatataaaataaaaattcctgttccctcacttgaagaacaacaacgtatcgtaacaattttagataaatttgaaactttaaccaattctatcgtagacggtttaccaaaagagattgaattaagaagaaaacagtatgaatattatagagagcaattattaagttttcctcagtagataggagattaaaaaatgagtaaaacactcgatgaaattgcacaagaattaaagaataatagcaaaaaagttcagttgatttacgcttttaacggaacagggaagactcgcttatctaaaaaatttcagcatttagtctctcccaaagatagtgatgttgataattatggatttcacaataaaaagatactttactatagtgcattcacagaagatctcttttattggaataatgatttaactgaagatagtagtcgagtattacatatacagccaaatgcatttacgaagtggatatttgaagaacaagggcaagaaagaaacattgtaaaatcttttcagcgttatactaatgataaacttactccaaattttgatgaaaactattcacaaataacgttttcatttgaaaaaggaaatgaaattcgagaagataatataaaaatctctaaaggagaggaaagttgcttaatttggagtatattctatagtatctttgagcaagttatatctacgcttaatgtggcggaagttgatgaacgtgagacacctaattttaatgatctagaatatatttttattgatgacccagttagctcattagatgaaaatcatctgattgaattggcggtagatattgcttatttgataaaatgtagtaaatcagaattaaagtttgtcattacaacccataatccattattctataatatattgcataatgaattgaatagtgataacaaatcattgggatataaaaagaaagagtttgaaaggtatcggctagaaaagttagaggacggcagtcataggttagcgatacaaggtaatgattccccttttgcatatcatctatttcttaaaaatgaaatagaaaatgcaatacaaacagggcaagttaaaaaataccatttcaattttttgagaaatcttctagaaaaaacatcaattttcttagggtattccacgtggggagatttattgcctaaggattcaagttctagcccaaatccatatttatcgagaatcataaatttatctagccattctaaattctctggagaggaaattcctgaattaacagataatgataagcgagtattacagtatttaatgcaagaaattaataacacgtaccattttaatcaaagcgaaaattgaatatatgaccactgaaaccaccctcatcacagaaaccaacaactttatcattcttgataaatataccaagatagaacaacctaatttaggctaccaaacagaagctgatttagagcgagagtttattgccgatttacaaacattcaattatgagtatcgtacagatattaccacgcctgaaaaattattgagcaacgctcgtgaacaattacaacaattaaataatgtcgtttttttagacagtgaatggcaacgttttttaacggaatacctagataaacctgctgaaaatattattgataaaacacgcaaaatccataatgactatatttatgattttgtttttgatagcggtcgcattcaaaatatctatttaattgacaaaacaaatattgcccgcaatcgtttacaagtgattaaccagtttgaacaagctggttcacatagtaatcgatatgacgttactattttagtgaatggattgccattagtgcaagttgaactcaaaaaacgaggagtggcaattcgggaagcctttaaccaagttcatcgttatagtaaagaaagttttaataaagaaaattcgttattcaaatatctacaaatttttgttatttctaacggtacagatactcgctattttgccaatacgaccaaacgagataaaaatagttttgactttacgatgaattgggcaaaatctgataatacgttaatcaaagacttaaaagattttaccgcaacattctttcaaaaaaacaccctacttaatgtattaaccaaatattctgtgtttgataccagtaataatttattaattatgcgtccatatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttgccgtcagtagtgtagatgcagctaagttgtattatgagagttttaaacagcaacaacaagcggtcgaaaaaccactgaaaattgcaacaatcttttcttttgccgctaatgaaacgcaagatgccataggggatatcgaagatgaaacctttgaacctaccgcaatgaatagctcggcaaaagagtttttaactacggctattcacgattacaatcagttatttaaaacgacctatagcatagaaggtaaagaatttcagaattattaccgtgatttagcgaaacgggtaaaaaatcaagatattgatttattaattgtggtcggtatgtttttaacgggatttgacgctccaacactaaatacgttatttgtcgataaaaacttacgttatcatggtttattgcaagcttactcacgcactaatcgtatttttgatgcgaccaaaacattcggaaatattgttgcgttccgtgatttagaacaagcaacgattgatacgattacgttatttggagatagcaatactcgtaatgtggttttggagaaaagctatcaggaatatatgaatggctatatcgatcaagctactggcgaagctaaacggggttattggtcagtcgtcaaagagttgcaaactcgcttctcagatccagcaaaaattgaaacggaacaagataagaaagagtttgtgaaactttttggcgagtatcttcgccttgaaaatattttacaaaattacgatgagtttcatgcattaactcaaggtgaaaaaacgaatattgttgatggagtagaagaacctagtggagcctataatgttggtacaactgtcctgacagaaagagttattcaagattatcgttcaacttatagtgatattcgggattggctacgcaagcagaaaacaggcaatgataaagacaagacaacgattgattgggatgatgtagtatttgaaattgatctattgaaatcacaagaaatcaaccttgattatattttagaactgattttcgaacatcataaaaaaacaaaagataagccaacattaattaacgaaattcgccgaattattcgctctagcgtaggtaatcgagcaaaagaaagtttgatcgttgattttattaatcaaacaaaccttgacaatattccagataaagccagcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattttatgcttcttcgttaagcctgcatgatgtgataatttcttcttaagttggcatagtctgtaaaaaaaccaacacttttgtctactatgcccattattttcttcttgcaattacacccaacaacaataccgcactgcaaaacgcatacagcaagtgattaccatattgagcaaacagcgtttgccctttcattgcaggcacgctggcagttaaggcggtggcttcaaattgtggagcttgggcggtgactttgccgtaggcatcgacaaaggcggtaatgcctgtgtttgtcgcacgaattagcggtttgcctagctctaaagctcgcattcttgccatttgaaaatgttgccaaggacctatactcgtgccaaaccacgcatcgttggaaatcgtgagaagataatcggcttggtgagctttttgattttgctgaacttgatcggtgaagataatttcgtagcaaatcgctaaattaaaggctctgttagccgcttgtagtggcgactggataaatgtcccttgcgataaatttacaggtaaaacaaagacttctctcatccaatctagcaaattgccaaagggaacatattcgccaaaaggcaccaagtgatgtttattgtaacgaggcgattgttccagcgaatatggctgttgcggattgcctagcacagtggcactgttaaataactccgttggagtctgatgtagcgtgccaataataatttcactgcctgttctagccccaacggtttgtaactgttgtagtaaaggttcaatttgagcttctacagcaggaattgccgactcaggcaaaacgattacctgatatttaccaagtaacggtaatatcagttgctgataggttcttacggtgtagttaaaatgggatggatcccatttcattttttgctcaatattcccctgcaccagagccattgttgttggcggttgttgttcaccgatttcaacaaaacgaataaattgtgaaccaaaggcaagaactaacaggctgacaacaacggcataggaagcggtcggaacagtcgctttttttgcgagatcacggcagatcgctaccagataaccgctgattaccataacaaaaaagcttaagccttcaacccctaaaatcggtgcaactcctgaaaatgggctgtcgatttgactataaccaaattgtagccatggaaagccagtaaagacaacacctctcagatattcagttgcggtgaatatgactgcaagtagccaaggattagccagtttaaaccgttgtaccagataagcgaataagccaaaatagagggctaggtaggcagagagcagtaatacggcaatatagctgacaatttcaggtacgccaccaaactggatcatactaacgtgaacccagttcaccccaatacaaaaatagctgacagcccataagaatgttccccatagggcgattttcttattgttgtgtgtagcaagccaaatcagaccgcttgcagataagaagatgataaaccaatagtcgaaaggagaataagctagggttcctattccgcctgaaactaaggcgaccgcacaagcggttaaaaatgacgatttttttacagctttcattcgtcttgtttctcttgttgcattaatgctaattgttcatcactgacagtcactcgcagttgaattaaacgacggctgtcagcagaggtgactttaaacatcattccgcctaattcgatttcttcgcctcgttttggtaaatacccaaaggcttgcattactaagccgccgacggtatccacttcttcatcatcaaattcaattgcaaattgctgattaaaacgttcaatatctgttaaggctgacacagcgtaggtgtgttgagaaagctgacgaataggttcgatttcttcttcatcaaattcatcttcaatatccccaacaatctgctcaagaatatcttcaatggtcactaagcctgaaaccgctccaaattcatcaactacaatagccatatgaaaacgttcggaacggaactcttttaacatacgatctacccgcttgctttcagggacaatcacggctgggcgtagaatttctgccatattgaatggttcagaatcggaacgtaggtatttgagcagatcttttgccagcaaaataccttcaatggtatctttaccgccatgcaccacaggaaagcgagagtgtgccgattcaataatcacatcaacacaagcctctaatggctgttcggcatcaataaatacaatttgcggacgagggatcataatatcacgcacacgcagagaggaaatttccattaccccttcaatcatctctttagtatccgtatcaattagctcattctcagcagaatcacggatcacttcgaccaaatcttcacgattttttggctcttgttgaaataagccaccaaatagcgactttaaaaaggacttattatcttgcgtatttacgctatgttgttcatcactcattttattttctcgttataagttaagcagaggaaaattatcataattccaataaaaaatcgacaacgaatggaatttctctctttctatttacacaaatttagcataggatatagcagttttttacccttatacccttttaggagattatgttatgaaattaggtaaaattgcccttgcaatgacagctctcatcgctggaacaacggcatttgcaggtacaatcacgggttcttcaaatgtaacttttcttgcttttgatggacaaaaagtaagaagaaatactaatttacaggtaaatgataccaatctacaccaagttgtagtagaaatatccagtatctatcagtctggttctgatagtgccttttttgagtctcaacctattattctcacttttgaaggaagtactgaagatattaaaatccttgcacctagtttaaatagtgaatttgatatagcacaatttaagaaatcacccagtttcaaaattgaaactgtttcaggaaaaaagctaacatataagcaagatttcctaaaaggagaaggttttatgcctaattcaaatattatcaataacttggcaaactacaatattggtgaaggtgttgctgctgtacaaaaatttgcattatcaactatgccaataacaatggcaaataataccaataaagttaataaggggaaaattgttgtgcaaggagaaaatgtcacagaacaacaacttcaatactggttccaacaagcagacaaagaaacacaaaaacgtttcttagattgggctaaaaaacagtaatctacgaagaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgattaacttcgacaatatctgtaaaacggatttgatcgtttaaaaatgcctctactgcaatttcatttgctgcattcattgccgttgtagcatattgtccctcggcaaaagcctctatcgccaattttaagttagggtaacgagcaaaatcaggttcaataaaggtgagttcttttaatttaaagaaatctaatggagcaacgccagcgtagatacggtttggatatgccattgtgtgagcaatcggggttcgcatatcaggattgcccatttgtgcaatgacgctaccgtcaatgtaacgtaccattgagtgaatgatagattgtgggtgaatgatgatctccatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggtgaatgatgatctccatttcatcagctgaggcattaaagagccaacgagcctcaatgtattccaaccctttgttcatcattgtggcagagtccaccgaaatctttttacccatagaccaattcgggtgtgcgacagcttgagctggggtgatttgaccaaattcattcaatggttttgtacggaaaggcccgcctgaccccgtgagaataattttacttacccctagttctgcaagcgggcagaaacctactttttcttgtgcttctggcggcaatgattgaaaaatggcgttatgttcactatcgacagggagcaatttagcacctgacttgcgagcttcatcaataaaaatttgtccgcaagtgaccaatgattctttatttgccagcaagacttttttgcctgcttgcaccgctgagagcgtcggtaataagcctgccgcgcccacaattgccgccattaccatatccacttcagggtgtgaagccagttcgtaaatcgctttttgccctgcgagaacttcgattttcaatcctaaagcggtgagattttcttttaattttgcagctgcctgttcatcatctaatgccacgaaacgcggttgatattgttggcattgttcggtaattaattcgacattttttccgccaactaaagcgaaaacttgatactgctcagggttattatcgaccacagaaagggtgctttttccgatagagcctgttgaacctaaaatgactaatttttgcattgatcgattaaatcctattctttttattaaacatataattactgatgagatgatattattttatcttgctcatattctattaataattcatcaactaaatagccgtcagataaacaatgaaagtcaccaatgccttttcgcattaataaataagtatttgaatacataaatttatctaaagcttcaccaagagaaatatttttttcttgagcaaaaagagaaataatccgcgtatattttcgttgtaataatacagggtgagctttcatactttttcgcttcctttaaaaataaggtgttgttcaataattttttgttgcctaaaacaaatttgtaaattattttcctcatagattaaccgacctaatgcttcttgtcgtgtaatgagattttcaagcaatagttcaatggtattaaaaaccttatcattcgctatccctccaataataatatcatattcatcaacgggttgttgagttcggttagcaataataaaatctagccattgttcgctataggaataaaattctttagtacgatattgagtaaataaaccttcatcaaattcataacagtttataatagcatctttatttttctgtttaaaacgttccgcccaactgaccgcttgttgttttatcggcgttgtataaaatccttgcccaaaatctagtcgagttcgagaaaaagcaatattaggaaactttatttcttggaatgaaccgtgataaataatcataacacccctttttctttcattaattcaataatatctttaactaaataatcctttcctaaggtatgtaaaatatcataatgctgaataatataatcctgtaataaacggctatctttaagtttttgataaatttcactaggttcttgatttaattctcttgcaatataatcaatgcaaaaaagtgaaaattccaactctttagtcgaaagaatatttaatgtttgcattgttattccttattaatttgacaaccttttcgcatcaatcacatcatcaatttgtagaatacgttttagtaacttatccaacaattccacattatttagctcaatttgaacgtccattgttgcaattaaacgttttggatcggtgcgacttgatacgcctaacacatttactttttcatttgccataataccgctaacatcacgcaataagccattgcgatcatttgcaatcacccgaatggtcaaactaaatttgcctgaagcatagctctcgccccattctgcttccaccacccgttcagggctactactgcgtaaatcaaagagctgttcgcaatcagagcggtgtatagaaatgcctcgcccctgagtgatataaccaacgatctcgtcacctggaataggctgacaacaacgggcaatgtggtgcattagatttccaaccccctcaactacaacaaaaccactacggtttttctgttgctgttgagatttatttgccacctgttttaagatcgcttcatcggcttgctcagcagtggttttgatgagcttactctgcaaatagtgcattaattgatgtaaacgtatatcaccgccaccaatgcctgcataaagatcatcaatttgttttaagttgtagcgaggtaaggctaaatcctcaatctgtttttggctaaagttgaatttagccatctccgcttctaacatctctttaccaagcggaatatttttatcacggtctagctttttaaaccaagcaacaattttagatctagctcttgctgtattcacaaagccttgacttggaattaaccaatctcggcttgggtttgggtttttctgcgtaataatctcaacttgatcacccatttgtaaaatataggtgaacggcacaattcgtcctgcaattttagctccgatacaacggtgaccaatttcgctgtggattgaataagcaaaatcaagaggggtggcatttttcggtaaatcaaccacttcccctttcggagtaaagacataaacacgatcatcaaagacttgagaacgcatttcagccaccacatcgcccgaatcggcaatatctttctgccaatccagcaacttgcgtagccaaacgattttttcttcatagcctgaacgcccagccgttgcaccttctttatatttccagtgtgccgcaacgcccaattctgcatcatcgtgcattttttgcgtacgaatttgcacttcaatggttttattaccttggcccaaaacaaccgtatggatagactgatagccattaggtttagggttagcaatgtaatcatcaaaatgttcaggcaaatgtttgtaatgtgtatgtacaatgccaagagcggtataacaatcttgtaaattcggcacaatcacccgaaccgcacgcacatcaaacaactgctcaaaacgtagatgttttttctgcatttttttccagatactataaatatgtttagggcgaccataaatttgcacactctctaactcatcttgcagacaggcggtcagatcctcaacaaaatttgcaatatattgttcccgatctaaacggcgttcacctaaatcatatttcgcaatttgacgatattcctgagggtgtaaggctctgaagcagtaatcttccaactcccattttaactgcccaattcctagacgattagcgagcggtgcataaatatgcgaacactcttttgcggctaataccagatcttcttcgcttaagcgttcggtatcacgcaaatagacaattcgctctgcaagtttaatcacaacacaacggaaatcgtccaccattgctaaaagcatacgacgaatattatcaatttgaagatcggaagcgtgactggcattaagttggcgaacgttatccatctccaacacacctttgacgagatttttcacatcattatcaaaatgctctttaatctgcactaaatcaatgatgttttgcttcacaagagggaaaagtaaggcagcgacaaggctatcatcgtccatattcaaactatgcaaaatctcgaccaattcaaccccaaaccacatcaagtgattttgttcaatatcgattttttcctgtgcatatcgccacgcaatcagtaattgttcaaaggtaataggcgacatctgtagcccagcactccaactagccaactcaaaattgttcggatcgagccggtgtgaatggcgaatcgcaaccataagtcctccataacgcttaactgaaagggttcttgacagaatttgacaatgtaaaactgctttgaagtattataactgaaatcactccaaaatcgtggggattttttagatttacaaaattttaaaaaaatcttaccactttatacgtcataaaatgttattcacttgttataaatcaaacctattaagacaattatttgcaccaaccgcatggattgattaaaatgctccgtcttttcgggtggtttccaccttttttattttgtgggtaacaatgacaattttagcattaggtatcaatcataaaacggcatcagtgagcttgcgagaaaaagtagcgtttgtagaagacaaacgtcagcgtgcatttgagcaaattcgtgatcaaagcctagcagaaagtgttgtaattttatctacttgtaatcgtactgagctttatttccatcagcctgaagttccccctcaagaagaacaccctgataatattgcttggcgtgaacagtgttttaattggtttgctgaaattcatcaattagataaagaggaattaagcgaggcctattatttcaagcaaaaccttgaagctgctcgtcatttaatgagtgtcgcttgtggtttagactcgttaattttaggagaaccacaaattctagggcaagtgaaacaggcataccaagagagtgaagaattttatcattctcaaggaagtggcgtttccaccaatctttctcggctatttcagaaaacctttgctacagcaaagcgagtccgctctgaaactgaaatcggtagtagtgcggtatccgttgcgtatgctgcttgtggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagctcgccaaatttttgatgattttaaaaaactccgttttttattagttggtgctggtgaaactatagaactagtggctcgccatttaattaatcacggggcaaaaaatattatgattgctaaccgaactcatattcgagcagaaatgttagcggtgaaactagatattccaatgcaaattctttcgttaagtgcattgcaaatcggtttaaatcaaggagatgtagtgatttgttcaacaggtagtccagatattttgattactaaagaaatggttgaacaagcacagaaacaacgccgttttgacccaatgttattgattgatattgctgttcctcgtgatattgatgaaaaagcgggagaactagatagtatttatgcttatagtgtagatgatttacaaaatatcattcagcagaatatagctcaacgtcagcaggcagcagagcaagcgaaagaaattgttattgaggaggcaaaagatttctttgtttggttgaaacagcaacaatcaaccaatttaattaaacattatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttgaaaaagcgttgagtgccttgcaacaagggcaggattgcgaaaaagtactaaatgaattgagttataaacttacaaatcagttattacacattccaacacaagccttacaagcaatggcaaaaaatagcaatgttaaaggtctgcaaagtttttctaaagcattgaaattagaagaataactctttgttagggtactattttgccctaactctcttcatcacccgctctttattattttctccgttttcttttaaagtacgatataatgtacgtattttgcgtaagatgttcgtaaaccgattttaaatgaggttgtaatatgactcctgttgttgcccttgtgggcagacctaacgtaggaaaatctacgttatttaaccgcttaactcgcacccgtaatgcgttagtggcagatttccctggcttaacccgtgaccgtaaatatggtcacgcaaatattgccggacacgattttattgtgattgacacgggcggtattgatggtactgaagaaggtgttgaagagaaaatggcagaacagtcgctgttagcgattaaagaagcagatgtagtgctatttttagttgatgctcgtgctgggttattacctgcggacgtaggtattgcacaatatttgcgtcagcgtaataaaacaaccgtggtagttgcaaataaaacggacggtattgatgcagactctcatattgcggaattttatcagttaggtttaggcgaagtagagccaatcgctgcggcacaagggcgtggtgtgacacagcttatcgaacaggttttagctccccttgcggaaaaattagaagcacaagcggtcgattccgatgaaaatgttgcagatgatgaacaagacgaatgggatagcgattttgactttgataacgaagaagatacggcgttattagatgaagcattggaagaggatcaggaagaagccgacgataaaaacattaagattgccattgtaggccgcccaaatgtgggtaaatcgacactgactaaccgtattttaggtgaagaacgtgtagtggtttacgatatgccagggacaacgcgtgattcgatctatattcctatggaacgtgatggtcagcaatacactatcattgatactgcaggggtgcgtaagcgtggtaaggtgcatttagcggtggagaaattctcagtgattaaaaccttacaggcgatccaagatgcgaatgtggttttactgacaattgatgctcgtgatggtgtgtctgatcaagatttatcgctattgggctttattctaaatgctgggaagtcgttggtgatcgttgtcaataaatgggacggtttatcgcaggatattaaagacaatgtgaaatcagagcttgatcgccgtttagattttattgatttttcacgagtgcattttatttctgctctgcacggtagtggcgtgggcaacttatttagctcaatccaagaagcctatcaatgtgcgacgaagaaaatgacgacatcaatgctaactcgaattttgcaattagcaacggatgatcatcagccaccgttagtaaatggccgccgtgtgaaattaaaatatgcgcacccaggtggttataatccgccgatcattgtgatccacggtaatcaaattgagaagttgcctgactcttataagcgttatttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttccgtaagagtttgaaaattattggttcgccgatccgtgtgttgttccaagaaggaaacaacccatttgcaggtaagaagaataaattgaccccaagccagttgcgtaaacgtaaacgcttgatgaaatttattaagaaaagtaaaagataagagattgaagctatgatgatgcaatattccccgcaatttaacaatgcaaaagtattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcttggcgatgtgatgttagatcgctattggtttggtgccactaaccgtatttcgcctgaagctcccgtgcctgttgtcaaagttcaagagagagaagatagggctggcggtgcggcaaacgtggcaatgaatattgtaagcctgaacgtacctgtcactttacacggtttagtgggtaatgatgatgcagggcgagcgttggataaactgttaagcgaacatagtattcaaaatcaatgtgttgcggtagattctcacccaacgatcaccaaattacgcattctttctcgccatcagcaattattacgtttagattttgaagaaggttttcataatttagattgccaagcgttacttgcaaaattagcagcagaaattaccgcttacggtgcgttgatcctgtcagattatggcaagggtacgcttgatgccgttcaacaaatgattcaaattgcacgtcaagcaaatgtgcctgtgttaattgatccgaaaggaacggattttgagcgttatcgtggtgcaacactgcttacgccaaatatgtctgaatttgaagcggttgcagggcattgcaatgatgaaggcgaaatcgtggctaaaggcttaaaaatgatagccgattttgatttgtcggcattgctgattactcgttcagaaaaagggatgaccttacttcgtccaaatcaagatccattccatttaccgacgcaagcgaaggaagtttatgatgtcacaggggctggcgatacggtgattagtgtgttagcaactgcgattgcagatggtcgtcctttagaagaagcgtgctatttagcgaatgcggcggctggaattgtggtgggtaaattagggacatcaaccgttagcccaagtgaactagagcaggcaattcatcaacgtgctgaaacaggttttggggttgtgtctgaagatgaattgaaggtgattgttaaacaatcaaaaactcgtggtgaaaaaatcgtaatgactaatggttgctttgatattcttcacccaggacacatttcttaccttgaaaatgcacgtaagttaggtgatcgtttgattgttgcagtaaatacggatgaatcagtgaaacgcttaaaaggggaaagtcgtccgattaatgatttaaatgcacgaatggcggtgttagcagggcttgcttcagtcgattgggttgtgccatttggtgaagacacgccacaacgtttaattggggaaattttgcctgatttattggtaaaaggcggcgattataagccagaagagattgcaggtagccaagaagtttgggcaaatggtggcgaggttcgtgtactcaactttgaaaacggttgttcgaccacaaatgtgattaagaaaattcaatctttgtgaaccttttgctagaatagccttctaagtagcaggaattttttatctacaatattcataggaaattaaaatgaagtttacacaagtaaaatcattatttatcgcaggttttgctttatttgcattttcttcagctaatgcggaagagagagtcgttgcaacagtagatggttatcccattatgcagagtcaagtaaaacaggctttgggtaaaaaagcgaatacggaagctaatcgtaaagcggctttggagactattattgatgatttcgttgtgcaacgtgcgattaaagaatctggtataaaagtagactatgcttatgttgatcagatgatggaagatgttgctgctcaaaatggtataacatatggccaactacttgatgctttggattatcagggcattagtcttagtcagtatcgtcaacaacttgctcatcagcttttaatggaacaagttcggcaacaaagtattggaaattctattcaagtagatccgaaagatgttcaatctttagcgaaggatatgctagataaagcaaaaacaaacggtacacttgaaacagtttccgctacagaatatcgtattagtcacatattgattaaaacgacgccaatcttaaatgatatgcaagctaaggcaaaattactatcaattaccgctgacattaaatctggtaaaataacatttgaagaagcagcgaaaattaactctgtagattatatatctggtattgatgggggagatctcggttttaattttctagatgtctatgattcaacttttgctaacattgcaagtaaaagtaaaattgatgtgatttcatctccttttaaatcacaatttggttggcatatactaaaagttactgatactcgcagaggagatcgtacggaagatgcttatttacagaaagcttacgagcagcttattgataaacaagtgcaagtggcatcaaaagattggataaaagtattgagaagtaaattagatataaaatatttttaatttatctaataattaagggagcctcgcatatgcgaggttctttactttattaaatttataaaaatcagtgggaacataaccgcttattaaggtatccaatgagttcaaattcaaaaaaacatttagggcataccgctcgtaaacgctttggtcaaaactttttacacgaccaaaacgttattcataatattgttgcggcaattaatccgcagcaaaatcaatttttattggaaattggcccaggcttgggggcattaactgagccagtggcagatctagtagatcatcttactgtggtcgaattagaccgtgatcttgcagaacgtttacgccatcacccgtttttacatcaaaaattaactgtgattgaacaagatgcgttgcgttttgatttccgtgcctattttgatagcctagccttgaatggcaaagctgtcaaagtgtttggtaacttgccttacaacatttcaactccgttgatgttccatctctttaaattccacgacttaattcaagatatgcactttatgttgcaaaaagaggtggttaagcgtttatgtgctgcaccaaatagcaaagcctacgggcgtttaaccattatggtgcaatattattgtcaagtaatgcccgtgttggaagtgccaccaacggcattcaaacctgctccgaaagtggattctgcagtagtgcggttagtaccatataaaacactgccgtacccagtgaaagatatttactggctaaatcgtgtgaccacacaagcctttaatcaacgtcgtaaaacattacgcaacgcacttgctacgctgtttaatgtagagcagttagaggcattaggggtagatttgaatgcacgagcggaaaacttatcgcttgcggattatgcccgtttagcaaattggttatgtgataatccaccagaaatagaaaaaaaaagaactagtcttgtttgatgaataataaaagttagtcccttctattgtcggaagttaagtcaatattcaggtgctagtatattgatcatagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtattccagatgtgtaataagtccaaattttaattggatctaatttatttttttaagataaaaattttataacatttattaccaaataacattggatattattttgtatactatgtttccttaattttcaaactttgacaaaatgggagattttttgctcatgttttaaaataggggctaaagccttgtaatataaggcttaggtcactttttagcaattatgttgttttatatgaaaaattattcttcaaatggtgcattaaatctttcaattctagcacctaatttttgtagtttatcttcaatgtgttcatatccacggtcgatatgataaatacgatcaacaatagtttgaccatttgcaatacaacctgccagaactaaactgatagaagctcgtaggtctgttgccattacttctgcgcctgaaaggttttcgacaccgtggcagatcgctgtattaccttcgatttctgcttttgctcccatacggattagctctggaatgtgcataaagcggttttcaaagatcgtttcggtaattttgctggtgccgttggcgactacatttaataatgtaaattgagcttgcatatccgttgggaagcctgggtgaggcattgtgcggatattgactgcttttggtcgcatacctagagagtcgagggtgatgctgttttcggtcacgtccacttgcattcctgcttcacgcaatttttcaattacggcatctaatgtatccgctttcgtgcctcgacaagtaattcgtccgccagagattgcggctgcaacgaggaatgtgcctgtttcgatacgatctgggacaatgtggtgttcacagccacctaaacgctctaccccctcaattgtgattgtgtctgtgcctgcccctgtaatttttgctcccattttgttgaggaaaatggcggtatcaacaatttcaggttcacgagcggcattttcaatagtggttgtgccttttgcaagggttgccgccatcatcacagataatgttgcaccaacgctaactttatccatcagaatacgagcccctgttaagcgaccgttcacttctgctttaacgtaaccttcatcaagggtgatagtcgcacccattttttctaagcctgcaatgtgcatatcgacaggtctagccccgatggtacagccacctggtaatgaaacttgaccttgatggaaacgagccacaagaggggctaatgcccaaattgaagctcgcattgttttgacaagttcataaggtgcaacataatggtcgattttgctggcatcaatatgtactgcgttattttctgcacgttcaacgacaacacctagtttgcgtagaatcttgacggtggtttcgacatctttcaaatcagggacgttcgttaaaataacgggttcttccgctaaaatagccgcaaataaaatcggcagtgccgcatttttggcacctgaaatatcaacagttccgcttaaagtgaaaggaccgtgaacacgaaatttttccattttaattcctttagatgatgtgattagcttggcatattgagcaaacgctctcttttccattgttctttagtgaatgttttgattgttaatgcgtggattgcattggttgcaaaaaattcagttaaaggaccatagatcatctgttgttgttttactttagacattgtggcaaagctgtcgcttactgcgataacaccataatgggaattttcaccttgtacataaacttcatcaagttctaaggcgttttttaggatttcttcaatttgtttgggttccattgttatttcttctcacaaaatagaaattttttaaaccagcctgctaaatcaaatagctctgcaaggctgtgtaccgcttgcggaacattaaataaacagtttttatttttttgttgatagaggtgaagtagttcagccagtaaggtaaagcctgaggaatcaatgctagtgagaccttttaaatcccaataaatgtgctgcaagcttttgggagataaaaaagaagcacgttgcttccaaagtggaagcaacgtgtcacgggtaagctcgccagatagttgaaccatcagactttcattgttttgctgaatatgccattgtaatggattttttgtttgcatacccgaattattttaatgtgataggttgttttgcagattgtgcaacctgagctgttaaagcgtcaattccttgttggcgtaaaataccgctccattcgttttgtttggttgcgaccatactcacaccttcggctgccatatcgtaggcttgccattcacctgttttgctatttttacgccatttgaaatctaatttgattggctgggcgttgcctgattgtaggacattgacacgaatactgacgatagatttgttgtctagcggtttttcgctttcaatttgaacttgttgatcgctgtattgggttaatacttgtgcgtaagattgttcaataaattgaccaaaggcggtgaaaaaagcctcacgctgaacatcagtcgctgacgctaaatttttacctaaaactaattgacctgcatatttaacgtgaatatgtggcataagatcattacgaacgatagtgcgtaaatagtttggatctttcttaattttgctttgatttgctttgatatcaccaaaaagtttatctgccgtttgttgcattaagacataagggctagtagaagccaaagccgagtttgaaacgaatgcagaaattgcaacaaagcctgcaataaaaaggtttttaagggttttgatcatcataaaactccaaaatgtgattttaaaagtgagcaattattccgctttaggttcagcggtgtcttccgttttgtcagatttcttatcgccatataagaactgaccgattaaatcttccagtaccattgctgagttggtatcagcaaagctatccccctctttgagcattgctgtttcgccttcaaggacaaatcccacattcagtgcaatgtactgctcgcccagtaagcctgctgttttaatagaaagagaacttgtatcaggaatttgattaaattcttcattaatagcaagggtgactttcggggtgtaggttttaggatcgagttgaatatcagatactcgtccaattactacaccgccaactttaattggcgcacggacttttagtcctccaatgttatcaaaagttgcatagagtgagtagcttttttccgaagagaagccttgtacgttggcaactcgtaagcccaaaaagactaaagctcctaatccaagaagtacaaataagcctacccaaaattcatatttaattgattgacgcataatttttcctattcaaatacactaacaagcggtgtattttgtctgctattttacaataatacctttgcttgtttaaccgccgaacataattgccgttaaaataaaatcaagccctaaaataaccagtgaagcgtgaacgacggttcttgttgttgcttggctaatcccctctgaggttggtagggcatcatagccattaaagagtgcaatccataccacagcaaaggcaaaaacaatacttttaataaagccattgagcagatcgcccattgtcacggtactttgcattactgaccaaaagctacctacatcgacccctttccaatctacgccaacgagtgagcccccccaaataccgatagcagtaaaaatcaccgctaaaatcggcattgcaataatgcccgcccaaaaacgtggtgcgataacacgacgtagcggatcgacggccatcatttctaaacttgagagctgttctgtcgctttcattaaaccgatttctgcagtgagggcagagcctgctcgccctgcaaagagcaatgcggtgacgacagggccgagttcacgcaagagtgaaagagaaacgagctgtcctaagctggtttctgccgagaaatcgactaagacgacatatccttgtaaacctagcaccattccgataaataagcctgatagcataataatcagtaaggattgtacgcctaaaacgtgtaactgcttgataaataaaggggtatgtttacgaaattctggcttaccgactaaagcaccccacaacataaaggtggctcgtcccattgctctaatagcctgaataacggaagcacctattgaggatataaactccatcattgaaacagttcctccgtataattttgagcaggatagtggaattgcactggcccatctgcttttcctgctaagaattgaaccacttgtggatcttggcttgctaataaactttcaggtgttccttcagcaataatgcgtttattcgcaataatataggcgtaatcggcaatacttagcacttcattcacatcgtgtgaaacgacaattgaggttaaattgagtgcttgattgagctttttgattaattcgacgataacgcccatactgatcggatcttgccctgtaaaaggttcatcatacataataagatcgggatctagagctatcgctcgtgctaatgctgcacggcgagccataccgccagataattctgaaggcattagttgtgccgcccctcgtagcccaacggcttcaagtttcatcaaaactaatttacggattaactcttcgggcaattgggtatgttcacgaatagggaatgcgacattatcaaaagttgatagatcggtaaataatgcaccagattggaacaacattcccattctttgacgaagttgatataaggttttattgtttgcttggcaaatatcttgcccatcaaagagaatttcaccattttcaggtaaaatttgcccaccgataaggcgtaacaaggtggttttaccgatccctgatggccccataatcgctgtgattttgcctttttgcacttgtagatttaggttgtcgtaaatcacacgttcacctcgtttaaaggtgaggttttttacttcaaccaaattttttatctcacgcattcgttttcttctagtttaaaaatacgataccctttgaaaattaaagggggtattgactgaaaaatggcttgtgataattaatgaatgagcaattaaagtcaatgttctttaaagtaattgacaaaattccatttacaaaaaagcatattggctcgaagcataccaatatgcttaatgtttagcattaatgtctttattgtacgtaggtaaacactttcacgactttgacgaccccatcgacgtgacgagcaacattggcagcggcatctgcttgactacttgataaattacccattaagaatacttcaccattttcagtaatcactttgacatctgttgctttaacagagccgttcacaaagagttttgatttaatttttgtggtaatccagctatctttgctaatttgtgcaaccccaattttagggccgatacgaacttcgttataaaccgtagatacgccttctacccctgtagcgatactactcgccgagtctttggaaaaatcattagggacttgacctatcagcaggactttgccgttataagaaacgacattgatacgagcttcgctgttaagttgttgatctttattcagattataagccactttttcttccagtgtttcatcatctaactgacgacctgccgttcttggatccgttgcaaccttcgttgcgaccgctgctccacctacaacagcagtggctaaacaaccttgtaatgatagaaatgttaagccaaataggcttgcaagggtaatgcgtttaacgagttttaacatagtcctctcctatttcaatgttagtgtgatgtagttggaaacagcagattatccaccagctcacagattaaattcacgcaaaattgatgtccttcaataattcgcatttcattaattgatggcatctcaatatccagatcggtattatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcaagcagtccttttgtatgatcatttagactactggtaaacgcaaaaatttccaaattttcgttatttgcacaatgtatcgcatttaagaccgcttgttcgttgcctagtggagaaaatgcaataaacagatctccctcttttgcaatcacttgtagctgtttacgaaagatttcattgagatcttgatcttggtttaaacagcccacgagcattccatcaaattgcagtaaatgtgccgataagctaggtcttacaagatcatatcggtgtaacaaattactcaccagcaattgtgcattggcataagagcgtccatagccacaaacgatcactttattgcctcgcaacaaacaagctacgatacgattagccgcttcgtttaatacttttggcagtaattccgctgcggcaatctgaatttgaatactttcactaaagcgatcttgaattttttctaacatactatcctaaaaaatttttgatccaaataggtgaacaatcaccttcaaatgccacaacatcaaaacgacaatttgccgtatctaaagattgatttcgttgtgcaagccataaatttgctgctttttgccatttctgctgcttgcgaaaatcaatactttctaccgcagagccaaaataggcatttttgcgttggcgaacttcgacaaaaatcaaggtatcgccctcttgcataattaaatccagttcgccacatttgaactgctgattttgggcaataaaccgcaagccattcttttctaagaaaattttggcttgctgttcaaaatatgcaccttgtgaacgcatattagtttgcatcaacaatagaaccgccacgatattgtagccagttcatttcacgctcaatattacaatttgggcctgcactcagtacgcccgttaatccgtgaactttgtaacctggaatttgacggaattcgttgaatttattcgcaatagaccaagtgtcagatcccattgcatataaacgcatcattgaaaaatcgctttctacaatttgctctgcttttttatattcgctagatgaaggatcagataaaagtggaatttcactgaatttcactccctccatcgttaaacggaaatcaggcccattgtttggcgagttactacgtgaagaagtataaattgggaactgattagcaagcggtgagttatctaaactttgtttcaaatcagataattgctctgctgttcctaacgcatataaaccacttccctgtccaattcctgaaccttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaagcgaggttacttcaaaggcttgattgtagtaacgaatgtctgtatccctattggtaagctgacgccaacgttgagcaaaggcttctgcagaacgtgtgccaaaatcgccattaggtgcaactacaaccgcatgctgtaagccatctttcaggaaacgttcagccgcagaacgtgcttctgcttctggcgataacccgtagtagcacactttggcgacagctcttacatttggagtagaattgagtgcaagaacattgatattgctaatttcaggactggttagcatttcatctactcttggttttaacaatggaccgataatagtttgagccccttgttgcttcgcctgcattaataaatcattaataggagcactatcagtatcaaatacctgaacttgcatggttgttgtgcccttagcatcgtcaaaaccacgcttgatgatttcccctaaaatttttgcatcaccacttaaaggcaataataatgccacgccatttaattgggtttgttggaaagaagatacatttcgcaattcaattggaagcaacaatacggctgagtgattagggtattgctgtttccacatttcgatcacttgaggcaattgtgccggattagacatattttgattataagcaaccactaaagccaaccaaccagctaatccgatttcaccaggacctgccaccgctttttctaacataccacggttagcattgcgtaacatctcccaaattttgtcattattcgcttggcgactttgagtatccgtcatatagctatccatcaatgctcttgcattaactgccgcaatgacatcattttgattttcagcaatacgggcttgagtttgatacacacgcagacgttgagattggcttaatagtgtttgtggtaaagctctcaatacaccttgagcctctgaattgttcccttgtaatgcagctaattgagcaattaaaagacgatgttcaagtttttgctcatcgtttagtttagctaccaaaatctctgaaaaggtattctgagcttcaacaaccttattttcttcaattaacttgcgaacagctaacaaacgataactttgctgttcctcaatattgcggctctgttcggctttattgatataaaattcagagttaccataagcctcgttttttaatgtttcagtcactttattacctgaacaggctgccaacaacaaagcaagggcagtaggaataaagatcgttttcattttttggcgaaagccataactttgtactaaaatagttggcatattattgctccataaatttggctattatctagacttaagttagtctgtgaatattaggcagatcttacttatcaactaagcgaaaatcaaatgaaaaacgaatactcacctaaacaaatcggtacattatatattgttgcaaccccaatcggaaatttagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatttagaggacattactcagcgagccttaaatacttttgctgccgtcgatcttattgcagcagaagatacccgccatagcggtattctgttaagccattatggtataaaaaaacctttcttcgcactgcacgaccataacgaacaacaacgtgccaccgtgcttgtcgaaaaattacaacaagggcaaaacatcgccttaatttctgatgccggcacgccattaatcagcgatcctggtttccatctcgttcgccattgccgtcaagctggcattaacattgtaccaatcccaggggcttgtgctgcaattaccgcactttgcagttcgggtatcgcatctgaccgcttttgttttgaagggttcctaccagcaaaaagtaaagctcgttgtgacaaatttaacgaattagccacagagcctcgcacactcattttctatgagtccacccatcgcattttagactgcttaacggatatgcaaagcgtgtttggtggagaacgctatgttgtaatggcaagagagctaaccaaaacttgggaaactattcacggtgacccgcttgcacaattaatcgactggctacaacaagatagcaatcgtattaaaggcgaaatcgtcttaatcgttgaagggaaaactgcagatgaaagcgaagaattttctccgcaagcacttaaattactctccctattaagtgaagaattaccactgaaaaaagcggccgcaattgttgcaggcacttttggctacaaaaaaaatgcactttatcaatatgggttagagcattttaaataaaaaagagtgcttttatttaagcaataaaaataattcctatccaattgttttaaaaagaaattattttcattaaactgattgattttttctattatatgaataaattatattcatttattcaattatttttttaggctataatccgcctcgcgaatcacattatataggagaaaaaaatggtaaactctatcggtttagacaaggtgtctgctgagaaattagcaaaagagttaaatggcttattagcaagctaccaagtgttttacaccaatgtgcgtggttatcactggaatatcaaaggtgtaagtttctttgaattacacgcaaaatttgaagaaatctacgacgacttagtagttaaagtagatgaaatcgcagagcgtattttaaccttaggttacacaccagataacgcatttagccaatacttacaagtttcacttgttaaagaagacatcggtgcaagttcagcacaacattgcttaactggtactttagaaggcttcaaaactctacttaaacaacagcgtgaaattttagcgttagcaaatgaagcagaagatgaaggtacagcctcacaaatgagtgactatatcaaagaacaagagaaacttgtttggatgttctcatcagcagcaacttgcggtgtttgccaacagtaatttaaaatctcaaaaagacctctttggtagtaaaaccacagaggtctttttattttctatagaaatcggcgcagtaggcaaaagtattagttttaatcatgttctctaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatgttctctaattctctccaatacttttgtctccacttctttgtatagctgaaaaacaggtagaatattactaataaataaccacgaatttctcttattaaaacaaactctgctgtccactcaaaaactcaggtgtctcttttgctttaaatccatagctcgccaaatagcctttcagactttcgatattgtagaacgaatggctattggtggtgttttgaaaatagagataaagctgatcaaactccgcttttcgctgatttaacaatgttgccagttgttgtaattcggtttcgctataacgataatcgtggcgttcttgtgccgattgggctttccaccagtggggattgcgaccgtgtaatcgtaggtaagcggtgcgttggttcgcataaaactgaaaggcaggcaaaccgatattctgcggataatccacgttacaccaaatcaaattttccttgccgtgaaaatagtctagcaccgactgcgtatgccaactggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccaactggtatggcgaaattcaatcgcaaggggataatcactgaaccatgacaccagctccgccagatagtaacgattggcgtactgacgctcgaaactgattgggaattgcacaaataaattggctaaacaatggctatcacacaacggttgtaacgcagccaaaaatgcctgtgcttgctctgcggtagcggtacgtttatggctaaaatcttgatgcagtttcaccgaaaattttaaccgcccttccgccttttttaatataccttgcacagccttatagccaatcgtggcgtgaaaggtactattgatctcaacggtgtcgtaatgctggctgtaaaccgacaaaaaatccgctttgtccgttccaaacggatagagcgtaccgactaaatccgtatcgctataaccgcccgtgccgatgtagatgtggggtgtgttcattaggatgtaagccacttctattcaactcatgtctactataatattaaaaacgcagtggaaatcccactgcttttaacttattgatctaactgaaattaaaatttccaatctaatcctaaatttatttgataactttgtttatatccattaccaaataatttatctacatcaagatataaatgagtattattgcctagacgagctttcatacctaatcctaacgttgtccaagttccacgatgattgatattatgttgaactctgtctgtggcactacgaatgatattaatatcttgtgtagcgttaaattctctatgcattgcgactttagtatagaaattcaaaatttgattgagttgatattctgccttagtcccaacgctacctactaagctattgatttcgtcagccgttacattcaagccatttctaatatagttcgtagaacttaggtgagtatagaataactgcgtatatggttcgatttcccagcggttactcaattcaaaacctttactataagccagtgatgcagaatagagattgtgatgatatgtctgcgaagcattggattttagttcactagatgcttttgccattctcactgcaacatcaaaataatgtcgctcttctgtttcgtaagcaccatataatgccataccgtatgtttgggttttatatgtttcagagaattgagcaaagttagccttgcctttttcaacatctaaagcgaagccaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagctgtgccattatccaacgccgaggatttatcataacctacttgtaatccaaaattgttgaatttatatagatcctgcgttattcgatcagaacttgaattaacccataacctacctagctcagaaaccgtcgggatcatgccgtttaccgttgcagttaaatacggataagcattacttgaacggctgtgttctagtctgtttcggatagaatttaatgcaaagttagatacaacggtggcataacgactttccgcaatcgctcgctgtgtttcctgttctgccgtggtgattgtgattttattgtggtttgtagatgtactcgacgttgtcgcttgttcacttgttggagcttccgttgtcggagttgttacgactgttggttgtgttggtgtagatgttgcagtgtcagagctagaagcctccgcttgatcgtctgtttgagctgtatctgttggcgatgttgtatctgacgaaccagcctgttcacctgttgttgctggtgtgctatccgtaggtttagcagggggtacatcagtattactgctgttagtcgctgtattttctgatacaggttgagttacttctgtttttagcttcacaacatagctgccattttctcctactaaagtgctgccattaggaagactaacgttattatctttatcttctgtattaatagtcaattcaccagtaatattaccattaatcaaaagagcattgtcccgaacgatagtgatattactattattaccattggtatggatattatttaacatcaaactagtcttagcgatgtcaccaaaagcatctttactcgccactgtagtgattgcggattgattattcagagttaaggtttctgaaacagataaattcttatccaaagtaatacggctattatttaatgttaaatctttaacatcttgtaaagtgatagcagtttcaggattgatgttatttaacgtaacagaaacatttgtagcttctcccgtataaattttagttacagaatttgatgaactagtaaaatgaatagctctattatgtgcttgatcattatttactccagctaaatatattgcatcaactaatccaacatgttcccctaattgtatgtttacaggagagtcatcagaactattttccgtattatcgctaatgattaccgaatataatttagtttctgctgaatttgaagtaacaataagggtattatgtccattattgcttttagtagcatcagcattcccgagccaaataattgggcgagtatctgaaggttcgctatcaacattcgttgtcacattatctaatgtcaatttattgccatttgtcacaatataggttggtttcgcttccaaattatccattttaaatccagaactaaaaatattgtttaaatctcgactaggttttaaggataaatttacattcgaaaaagtaacatcttgtcctaaggacaaattataaccttcaaggtgtaagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttccttgtccatcaattgttacttgtttatcaacattgaaaaaaccacttccacgcaataattgagtatctccgtctaagcgaattgtatcgccatctttggcttggttaagtaaacgttggaattgttcgccgcgcacattgttattttcaccagtaacaatataagtttcagcattggcattagtcactgtaactgtaattggggataaacataataagatagctaacgctaaaggggattttcggaaatgcatagatgatccttaggaagatagaaaaaaacgattaattctaatgagttttaccaagagagtaaaacactatgatggctagaaattatactttttactattttgctatatgttaaagctatcaaaatacgatataaaattgataaaaccacaacaaactaatgaaattcctcgcaaaaaatgctacatttctcaggttgatttttatttatgtacggagaaacctgaatggaactgaccgctttaacagcgttatcccctattgatggtcgttatcaagataaagcgactgcacttcgccctattttcagtgaatttggcttacttaaatttcgtgttaccgtagaagttcgttggttacaaaaactggcttctcacgcacaaatcaacgaagtttcagttttatctaaaaacgcaaacggttacttaaatcagattgtcgaacatttttctattgaagatgctgagcgtattaaaacgattgagcgtaccacaaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgctgagcgtattaaaacgattgagcgtaccacaaaccacgatgtcaaagccgttgagtatttcttaaaagagaaatgtgaagccttgcctgaactgcaaaaaatcaatgaatttattcactttgcttgtacttctgaagacattaacaatacttctcacgccttgatgctcaagacagcacgagaagaagttttgttgcctgagtggaaaaaagtgattgatgccgttgtggaattggctcaccgttacaaagatattccgttactttctcgcacacacggtcagcctgccagcccaactacgattggtaaagagatggcgaatgtggcgtatcgtttaaaacgtcaatataagcaattagaaaacttagagattttggcgaaaattaacggtgcggttggaaattataatgctcatctatccgcttaccctgaagttgattggcacacctttagccaagagtttattcaatctttaggggtaacttggaacccatacaccactcaaattgaaccgcacgattacattgcggaattttttgattgtgtcgctcgctttaatacgattgtgattgattttgaccgtgatatgtggggctatattgcgttaaatcactttaaacaacgtacgattgcaggtgaaattggctcttcaacaatgccacataaagttaatccaattgactttgaaaactcagaaggcaacttggggttagccaatgcagtaatgaaccatttagggcaaaaattaccgatttctcgttggcaacgtgatttaaccgactcaaccgtattgcgtaacttaggtgtaggtttgggttatgcgttgattgcttatgcttctacgctaaaagggatcagtaaattagaagttaatgaacaacatctgcgagatgaattggatcaaaactgggaagtgttagccgagccaattcaaacggtgatgcgtcgttatggtattgaaaaaccgtatgaaaaactcaaagagctaacccgtggtaaacgtgtagatggcgaagcgatgcgtcaatttattgatggattggcattgccacaagcagagaaagatcgcttaaaacagatgacccctgcaagctatattggctatgcggtggaacttgttgaaaagctataacctttcttcataatagtagggacacactgcgtgtgtcctacattttcgcttttcaaactgtatattccattcgtttcgtaaatttcttgttaaaacgcaccgcttgttgtatattcacccttactttctctttccaaacaaggaactaatatgttgaatatcgtttttcttgaccgcacaggcattcctgccactcacaacattccacgtccgccttttccgcataattggattgaatacgatcgcacttctgctgaagaaacctacgagcgagcaaaagatgcggatattgtgattaccagcaaagtgttattcggacgagagttattagcgaggttgccgaaactgaagcttattgcaattacggcgacagggacaaataatgttgatctcgttgcagcaaaagaactaggcattgcggtgaaaaatgtaacgggctattccagtgtgacagtgccagaacacgttttagggatgattttttcattaaaacatagtttaatgagctaccaccgtgatcaagtcaccagcgaccgttgggcaacttgtgggcagttctgctatgtcgattatccgattaccgatgtgcgtggctccactcttggcgtgttcggcaaaggctgtttggggacggacgtcgggcgtttagcagagttagtcggcatgaaagtgctttatgcagaacataaaggtgcaacgactattcgtgatggctataccccttttgaagaggtgttaaaacaggcggatattgtcactttacattgtccattaactgaaacgacccaaaacctgattaatgcagagaccttggcattaatgaaaccgaccgcttatttaattaatacgggacgtggtcctttggtagatgaaaccgccttactagatgccctagaaaatggcaaaattgcgggagcggcattagatgtgttagtcaaagaaccgccagcgattgataatccgctcattcaagcggcaaaacgtttaccgaatttattgattacgccacacgttgcgtgggcgagtgattcagccgtgacaatcttagtcaataaagtggctcagaatattgaagaatttgtcaaaacaggcaaataatttgtaattaacttaggagttcctatgaaaaaaacagttttaacccttgctttaacagcacttttcggattttcaacttcagcgatagcaaattcagctacccaaattgaagtgaaagttcaacaacttgatttacaaaatggcaacaaagatgtgggaacggtgacgattaccgaatcgccttacggtttagtttttaccccaaatctgaaaggattgtcacacggcttacacggtttccatattcacgagaaaccaagctgtgaaccaaaagagaaagatggcaaattagtcgctggcttaggtgcaggcggtcactgggatcctaaagagacgaaaaagcacggttatccttggtctgatgaagcgcatttaggtgatttacctgcattagcggttgatcacgagggtaatgcgactaatccagttcttgcaccacgtttgaaaaagttagaagaagtgaaaggtcgttcattgatgatccacgcaggtggcgataaccattcagaccacccagcaccacttggcggtggcggagcaagaatggcttgcggtgttattaactaattttttgttgatataacagaaatctctaagacaagcgggtagattttggtagaattttaccaatttctactcgtattaattttttatgaacttaacaactcctttatttattgcctttcgctattggcgttctaaaagtggcgaccgttttggtcgattagtcacaaaccttgcaagtctaggcattgtattaggcgtgatggcacttgttatcgttctttctgtgatgaatggcttagaaaatatgcagaaacgcaatctgctttctatcttaccccatgcgattatttcacccatagatgaagcttggagcaaagaacagcagttaaatttacctgcttatgtggaaaaatctgtcccaattagccgtgcaaatgtgatgattcaaagtcagcatggcataaatgcagggcaattaattggcgttgagaaaaatagcgatgatccgttattaacggaagtaagcgatttagctgaacgcttacctgcaggcgattttaatgtattgatcggttcaaggttagccaatcagttggatctgaatgtgggagataaaatccgtttgatgatcacggaaaatagtcaatataccccatttggtcgagtgcctgttcagcgtctttttaccgtttcagatatttattattcgaataatgaagcgagtgcttataccttatttgcaaatttggcggatattgggcgtttattgcgtattgaagaaggtaagagccaaggtgttcgtttgtttttaaccgatccttttttagtcacggaattaccttcggcatttcctgcggataaatggctagtgaacgactggcgagagcaaaaaggggaatttttccaagcggtgagaatggaaaaaaatatgatggggctattaattagcctgattatcgttgtcgcaatttctaatatagtgacatcattaagtttaatggtggttgataaacaaggtgaaattgcgattttacaaacccaaggattaaccaaaggacaggtcacgcaaatcttcgtagcacaaggggctattgttggtattattggggcgtttattggcggaatatccggggttctagcaaccgcttacttaggtgatcttattcgtttcatcaacccaacagggctaatgttaccgacagaaattgcaatggaacaggtgatcatcatcgtatgttcatctattctgctctctttggcttgtactctttatcctgcttatcgagcatcaaaaatagagccggcggaagccttacgctatgagtagaaaatcgcctattcctgaaatgccttggacggcaaaacatcaatggcaacttaaacccagttcactctgcgtaatctcagtggcaaccattctaatgggaattggtgaagggctattagtactggcaaatttaggctctagcccgtggacagttttctcacaaggggtagcattacaaacgggcttgtctatcggcacagtggttgccattatcagcgttatcgtactgctactctggatcccacttcaactacgtttcggattaggcacactactcaatattttttggatcgctctctttattgatttaaccgtacaatatgtacctgctccagaaagcctattatcacgctttattctaatgataggggctattttactgtttggcattagcacaactttctacctttcgtgccatttaggtgccggaccaagagatggattaatggtcggaatgtgccagaaatacggctggaaagtcgggatcgtccgcacaacaatcgaagtgactgtatgtgtgcttggttttatcttaggcggaacagtcggcgttagcacattgttttttgccttgtgtgtgggttggattattcaatatacggcaatggttttggattgggaaaatttaaagaaacgagttcaaagataaactctaagatctttggaatagagcctctcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtcccctactgtcatatcgttcccttaaaaagtctgttgatttgttgcatttcggcttgttcctcaaagattgctttgatttgttctttgctcttgcctaaatgctgtaatagcttttcaagggtgattttctttgctccacctttaggatcttcccattcaggcacaatgtcgggattatgcgtaagctccactaatgcgaacctatcaaaatgtccgtatttctcaaaaacactgtctaaaatatccgtatcactaagagaaagctcgccccagaaatactcatctttttcatctactatttttgcaatgcttacttgatgattttccttatcgctaatccactcttcccacgctgtttttgtatggtttaaggtttccccacgaataagatttaaggtcttagatagcacaggtccataaggtaaagagtaatattcatcacctgtaatagaatgatctctttctaaccaacttaaacgatcagataaataaagcaatttcatcaattttatgtgatgcattgttccgcctgctttatgtagcaagtatgcccctgcttgtgctgtttttaattcgttgaacattatgctttatcctgtggtatttgttacaatcgtttacgcccgtttatgattagagagttattttactgattttttaaacagtttcaaggttgtttattagactaagcaataacatttgttttgcagaaaaaagtaataaaaaagcctagctgtaaaactaggcttaaacatcatcaggctactttctttaaatgatactggggtaatgccccttgagaacactcatctataaaatccgcccacgcttgcaatatttcaaagcgttgtttgatgtagtccgctcgattgtatgccattctaattcggtcttggtttatatgtgatagagccacttcgatcagctcagggttataacctttttcattcaggtatgtgcttgcgatactgcgtaaaccgtgagctactaacttccctttataccccatacgctttatagccgcattggcggtttgcgtgttcgtgtgggtttgtgggttcttatggctagggaataaataaaccttaccgccactgaatttcttaatctctcgtaacaaggctagagcttgtcgggataatgtgattttatgctctcgtcctttatcgtcttgtttaatccccttattgatataaatcgtccatatcttttctttttcgtctatgtcttcatattttgcagtagccgcttcattcgggcgtgtcatagtaagcaactgccacaaaattaaatagcgtgtctgtagctgaatttgagccgtattcaacgtaaataaaaactcgctcagatcttcgggtttgatcgtcttaaaatgctctacagtggggctatcaaattcttttgaaatattgattaaagggttgtgttggataatttccctatgcaatgcgaacgtcattatttcattcatcttttgaatagcacgctttaacgtttccaacgtgcccttttcttgcaaaggtttgaaggcttttaaagccattggagcagagatttgcgtaatagggtatttaccaaaagctggcaatagtattcgctcaattagactttttacatctctagcgtagccctgcgagaaattagcccgtgtttgtcgccattcgtaccacgcccacgctacattctcaaaggtgttatagatttctgtctgtttggcttgctctatggcttgacggtgagtgtgtgggtctatattttgagaaagcaaagatctatattcttccctaatttcccttgctcttgccaagtttacatcaggataactccctaagcctatttcagttctattttttgtgtatggtttatagtaattaaaacgccataatttcgccccatttggctttacaagtaaaaacaagcctccgccatcagttaaaggatattttttatctttgggtttggcgtttgctatttctgtgtttgtaagtggttttgtagttctagccataactgtcaccttagtaggacggcttttgatatatgtcagagtgatcctactaaaagtctattatttccgtttacgtcgagttacattgagagaaacaaaaaagccttgaaaggttgattttcaaggcttcttgttacgttcgtttacgttggtttatgtcgatttggtggagctggggggatttgaacccccgtccgaaattactccatcttcagcactacacgtttagtctagtctttaatttcgcttacccccagcggacagacacgcaaagaataagctagtttgatttaatttagtgtttcgatcctcaaacggcggcgtccacacgatctcgttttgggtgacttatcgaactcctcgtcttacgagcggaagctgaggcgataaggctatgagcaggttattaagctgctaaagcgtattgttcgtcgtttgcgactattttttgcggtttgtttacgaggcctaccgcacctcgacgtgcaccttggacttcgctaatcccgtcgaatccaagatcagccccaaaaagtctggcgattataaaggaaagcggtgagatttgcaaaaaatttttgttacatatttttgaaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgaaaactaatctactcaaaagatgaataagtagactaaacattaaaacggaaatgcattacatcgccatcctgaacgatatactctttaccttctaaacgccatttacctgcttctttcgcgccgttctcacctttgaattgaataaaatcttcataggcaatcacttccgcacggataaagccacgctcaaagtcggtatgaataaccgcagctgcttttggtgccgttgcaccaatagacaccgtccaagcacgcacttctttcacgcctgcggtaaagtaagtttgtaaattcaatagcttataacctgcacggattacacggtttagacctggttcttcaatgcctaaatcttgtaagaactcgattttttcatcatcgtcaagttcagcaatttccgcttcaatcgcagcacaaacaggcacgactaccgcattttcttttgctgcaatttcacgtacttggtctaaataagggttgttttcaaagccgtcttcattcacattagcaatgtacatggttggctttaaggttaagaagttataacctttgattgcgtgcagttcatctttatccagcacaacagagcgaatcataccgccagcttctaaagtcggtaggattttttccataattgacagctcaaatttagcgtctttatcgccacctttggctcgtttttgtaaacgttgaatagcacgttcacagctatctaaatccgctaaagctaattccgtattgatcacttcaatatcatcaagcggattgattttgccagcaacgtgtacaatatcatcgttctcaaaacaacgaacaacgtgaccaatcgcatcggtttcacgaatgttcgctaagaatttattacctaaaccttcacctttacttgccccagccactaagcctgcaatatccacaaattccattgtcgttggtaaaacacgttctggcttaacgatttccgctaacgcatctaaacgtgggtccggcataggtacaacgcctgtatttggttcaatagtacaaaacggatagtttgccgcttcgatacctgctttggttaatgcattaaaaagagttgatttacccacatttggtaaaccgacaataccacacttaaatcccattttattttcctattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaattttacgctttaaaaccattcaagcgattagtcgccttaacaattccttctttgaacagcagttccacacaacggctggcttcatcaactgctacattaattaaaggctgatccgacggcgaaggtttacctaacacataacttgccaccaagtctttatgccctggatgcccaattccgatacgcacacggtagaaattattgctattaccaagggctgcaataatgtcttttaaaccgttgtgtccaccgtgtccgccaccttgcttgattttggcaacacctgggaggagatccaattcatcgtgagcgactaaaatctcttcaggcttaatgcggtaaaaattcgctaacgaaccgaccgctttaccacttaaattcataaacgtggttggcacaagcaaacgcacttcgccttgtggcgtgttaattttagcgactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgaagtatttcgcttcctcttttaaggtgacattaaacacacgagcaagctcgttcactagccattcgcctgcattgtgacgagtttcttcatattttgcaccagggttagcaagcccgacaatcaatttaatttgcgacatagtttttgttcaataaataaagggcgatattgtaggtaaaaaggggaattttcacaaggaagatgtctatattttattgtcttaagccaacattattgctctatcaataatcggaattcgtttttaatataatgtcagtttgatttatgttttgtaggcgacttgatgtgttgtattacattttattttatctttttacttaatcttatgatttgtcaatttatttatcttaaaagctctatttttgatctaaattttacatattttgaatttttaatgtggcatacttcacatttttgacatttttctttacgtttggcggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggagaatactcgcttggatacatttcatttttaacttttaaatgtgatgtatcaaacgcggtttgtttatatgtttttaagtgttatagagcagatatatgacatttgcgacggcaaatgtggtgattattggtactagagtaatttttcttgcggagcaaaagagtgtcaatgttcagttgcaaaacagtagctcagatcctgcgttagtccaatcttggttagatcgtggggatattaacagccgtccaaatagtattcaggttccatttttagtaacacctcccgttgtgcgcatcgagcccaacgcaggacaaacgttgcgaatggtttttacagggaaagaaaatttgcctcaagatcgtgaaacgttattttatttgaatgtattagatgttccgcctaaacctaaagcggaggatttagggactaattatctgcaatttgctattcgttctcgtattaagtttttctatcgccctgctctctcttagcccttatgatgcttatcagtcagtgcaatggcttaagacagcgaagggggtcgttgtcgataatcagacaccttattttattacctatcaatctgttaagttgggaaatgcttatttgcctaatagcgaaatggttgcaccattttctagtaaaactttgatattaaaagggaaagttagtggtagtcgagtgaattgggaagcaattaatgattttggcggaacagaaaaaggggaagcagtgttgcgttagttcctcatgatgaaataaagagatggtgtcaaaatgaagaaaataataataaaacctgttccttttcggctggcaatgctcactgtgctgttaggcttaagccctactgttgttgcaaatgatgttaactctgttttgaataaaggggttgaagctgagttttatagtagctttttaacaatggggaaaattcagatttgattatacggtgtctaggcttcatcttgaaattccgcaaatttatgttgtacaacgtcctagaggctatatttctccacatttatggcaaacgggagtacctgttgcttttcttaattatgatttgaatagctatcaacattatggcaatacctcttataaacagcactatcttgctttgaatgggggaataaatttgggggactgggcttttcggcatgttggtgcgaaaagttgggatagttcaggagagagttcctatcatcgtattgcgacctatgtaaaacgtcccattgtgcctttgcgaagcgagcttacggtaggagattttaccacagatggggctgtcgttgaggcgatagggctacgtggcgtgcgtctggcaagtgatgatcgcatgttgccaacttccttgagaggatacgctccaactgtcagagggattgcccatagtaatgcaagagtaactattagccagaatgggcatattatccgtcaattaaatgtccctgctggtgcttttgaaatttcagatttaaacccgacaggatatagtggtgagttgcatgttgaagtgttggaagcaagcggtgacgacttttacttcttcgtatcagtaggggagagattgtagagagaagcggtgagattttataaaaaagatcccaccgcttgtattttaattaaatcttcgttttatctcttaccgcacctttatccgccgaagtagcaaaatgcccatacacttttagtgcaaaagagacttcacgctgacggtttgccggtttccagcctttcgcatcttgttctgctcggcgttgggcaagctcagcttcaggcacaaccagttcgattttacggtttggaatatcaatttcaatggtatcgccgtctttcactaaaccgattaaaccgcctgcggctgcttctggtgagcagtgtccgatagataagcctgatgtaccgccagagaaacgaccgtctgttaataaggcacaagccttgcctaagcccatggattttaaatagctggttggataaagcatctcttgcatacccggcccgcctttcgggccttcgtagcggataaccacaacgtgtcctgctcgcacttttccgcctaaaatccctgcaacagcatcttcttggctttcaaacacaatggcttcgcctttgaattttaagatcgcctcatctacccctgcggttttcacgatacagccgtctaaggcgatattgcccgacaacatcgctaaaccaccatcttggatgtacgcaaactctttgctgcgaatacaaccgttttgacggtcatcatcaaccgtatcccaacgggtatcttgcgagaaggctttggtggtgcgaatacctgcaggacctgcacggaagaatttatgtaccgcttcatctttggtcagcataatgtcgtacttggcaatttgttccgcaaggcttaagcctaacacggtgcgagtttgattgttcaataagcctgcacgatctagctcgcctaaaatcgccataatcccacctgcacggtgtacatcttccatatggtatttttgcgtgttcggtgcaactttacttaagcaaggcacttggcgagaaaggcgatcgatatccgccatcgtgaaatccacttccgcttcttgtgctgcggcaagtaaatgtaaaaccgtattggttgaaccgcccattgcaatatctaaactcattgcattatcgaacgctgctttggttgcaatagaacgaggcaatacagacaaatcatcttgctcgtaatattttttgcacagctcaacaatttgcgtaccggcatctaagaataactgtttgcgatcagcgtgggttgcaaggcaagagccgttgcccggtaaacttaaacccagtgcttcggttaaacagttcattgagtttgcggtaaacatacctgagcaagatccacaagtaggacaagcggagcgttcgatttgatcgcttacctcatcagacacattcgggttcgccccttggatcatcgcatcaaccaagtctaatttgatgatttggtcagacagcttagttttccctgcttccatcgggccaccagaaacgaaaattgtcggaatgttcaaacgtaacgctgccattaacattcccggtgtgattttgtcgcagtttgaaatacagaccatcgcatcggcacagtgagcattaaccatatattctacgctgtcggcaattaaatcacggctcggcagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagagaatagagcataccgccgtgccccatcgcaatcccatcatcaaccgcaatggtattaaactcttttgccacgccacctgctttctcaatttgctcggcaacaagttgccccatatctttcaaatgaacgtgtcctggtacgaattgggtaaatgagttcaccaccgcaataatcggcttaccaaaatcgttttctttcattcccgtcgcacgccataatgcacgtgcccctgccatattgcgaccttgtgtgctagtcgccgaacgtaatttaggcataaataatctctccaaattttgatgttgtgtttctataatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctagtaaaattattcattttatgaatcgtgaaataccgtttttgatcacttttataaaatctcaactgtcctaaaatatcttcggaaaataatatattcttcaactctttagatgctaagtatctttcaacgtcaaattgacgagtatctccagaagaatcctttactaatataggtagtgaaaatggtgaatcattcttagtaaaacagtgcaatccgtaagtaacaacgagtttataatccatttttttactatgaatgattagttcgtgtgcattaagatgactcatatcaaaagaggtattctcgaactcttgtgattcccacttctgtatggcttctatatgaaatttttttgtcattcttttttatagttcaaatattcgcttgataatattgtgtgacactttagatgttttatcaagccttttagccctttagcctttgaaggaatgcgaatggcgttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttatctaggacagccccataacttaaatactaccaccatatagcaattaaatagagttaaatggtacaggcataatttatagatctaaatgaaggtacataaatgttaaccgcacgaatttatataagagtacagtagtctgtaaaaatgtttagatttttatatatacctaaggtaccacacataaattcacgagcagataccaactctggtcttagtggagaaaggataagatcgctagcaaggactgccatatcaaccgtaatgccccgtgtacctctagtgtcaatgatgattaaatcatagccatcaattttttaacaaattgattgtatttcaggatacctccaggtgtacttgtaagatcggtagagagcttatctagtggatcgttagattggattaaatccaagttagagaattcggtccgagaaataatctcctttaatggaagatcaggacgagtgaaaaattcatacaatccaaaaggtccagaatcttcaatatgataataagacgatagggtaggttgaacatcagtgtcgatcattaaggttttaataccgtgatcagcacagaaagcacctatatttgcaacattcgttgattttgttactccacctttgaacattactgtaacaataaacggtttgatagactgtggcatacaaatctctccattttaattagtaaagaaatttgttttttttgtgcagtctaagatgatgcagtggtcggatacattcaagcaatgtaacatattgaaataaaaggttattttatatttaaaccctaaatcgtacccctaaacgtacccctataataaaaaaacgcctataaatagattattatttaatcaatttttagcggctaaacactacagcattttgaagtttatcacttgtatagggttgtttttaaaattggcggatcaggtgaagaaagttcactttttactatggtgatataactatgcttcggtgtcatctcctcaaaattgaggaaatgatttaattttaggataatccatttacttaaaataacacgccttgcaattttaagagactgaagaaaaccagtatcagcaaattcaacatctaccgccatcattctaggcataactattcacttttaatcaaaagatgatgatggctagaaccccgaaaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgctcgcataattcaagtggtcggcgtgtgccttgccgtcagagaatgaatggtaaaccttcgcttttgtgataggcacattcaacaagcgtaccaactgccctgcgtttgtcttaatgcctcccattgacaaatagccctctaggtcaatttcacccgtcgaaaatgccataatccgccaccgttgcaattctctattaccgccgtctttcgctccctgtattttccccacgccattaaataaagcgtaggcggtttgctctatgtacttgcggtttgagccttgcccgatttcatcaaggggcataaagttatcatttcgtgctgaggcttcattaatcaagcctagccctgtcgcattccacgataagcggattttgtcgggatgcccgtatagactgctggcaatgttagcggtagtggttttacctgcggttgagccaccgaatagatgaacgccaaaactttcagcttctatgatgttcattatcggggcagataaagcacaagccacgcctaacatcattgaaggattgcccagcacgttatcggcgatttcttgcctccagctctctattgtgcctttggtgtcgtatccgctcgcagtggcggattgtcggttaaatagtactggcgtttcaggttcgcccaacacttccccatttggcagaatataagccccattgtgccaccctgtagcgttggtgatgtgccatagggtacgcttaccgctactttgtaaatagtccgccaattcatttcttagataggtacgagtggttaagcgtagcccttttgctttgagctgtcgccatccctcccgttcgcctaaatcccccaaggataacgcctctttgactggttgcgatttgccctcaggcgtccattcaagcacgagataatgttcagcttcactttgccctatacctactacagaaatcacatcagaaagccattctgtacgctctgatagcagttcgcctgtgtccttgtcatatttcggggtaatgcgataaagcccctctatgccgttctctgtgcgtttttcgatataggcttgatgtttatctatgtcagcatttacatcatcgctagcggtcacttccgccacgttttccgccattgcttcaccttgtcgaatgcgttcgatatatccgcttaaatctttaaggtgttgctcggcttcgtcaatgtagtgaatgattttagcctttgtatttttcgcaaggtttaagtaaagtttagccataatctcaccgcttacatcttcaccgtgattagctcgctgtatcgtgatgatataagcctttttaggtgctatgcggtattgatgaacgttttccaaaacctcagcagtaagcacaatagggggcgatttctcaccctgtggtaacacatcatcaagtgctatctcgtcctgtgaacgttcagctggtggagctttggcaaaatcccacgcttgagagccgataataatataagcattctccgcattaggtttttgctgtttcatatttggggcgttttttaatttcatacattccccctgcttaaaatctcgtccgttttatcaatcagttgattaattctgtgggcgtgtctttgtaatacctctaactgctccgattgttcgcccaaatgccactgaataacgcttagagcgtgttttaatacttcgcctgtgtaagcggttggattatccgccattgcgttaatttgggcttttatgcgtgtgtggtctacgttcattcggtccaacaacgataaagggattttgatgtgctgaatgttactcatcgcctagccctcctatgtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcttgttgttgataagcaataattgctagagcttctttaaatgcggtggctcccgccatttcaattatgatttgatcgcccatttctaaccacaaaataccgatataaaacggtttgccgttgtcgtcttgttgttgctcaatgcgaatatagggaaaatctaaactgcttaacgttgctttaatcggtgctttcattagctcgccaatcccttggggtgataggtcatatttaagtgttttttcttgttcgttatttgtcattgttttgctccttaactgaaatcttgtacaacgcatcaaacttcttccgtagtggcgataactgaagtaataggctatcgcttggcattgctttaaattccctcgctagcgtttctattcgctcagataacacgattagcaattcatctaatgggtaaggttcatcatctgaatacaagctcttaaacgtgaatagaggcgttttagagccgttttcaatgtagtgcttaattgccatatccattacaagagggttcattttggcaattacgcatttaattactgcggtcatttgctacctcttcagcgtagtaccgatcttctcctttcagcatttcaatcactgcttcaatgatttcagtttgtgtaagtggctcgccctcgctacctaatactgccccgtagatacaggcttctaataatttaatcgcttcgttgatttgctcctgttgctcagtgagcaggtttttatttactcgcattcttcccccttaaactgtgataaatagcgttgtgtttcgtactcagtcagcattggtaaaccacatttagcacgctcaccatttagcaaggtgatagctttcaaggcttcttttgcattagggaagctgtaaatggtgtaagtccctgttccgtattggtttagtctttcggttttgtgaatggcaatattgtgtagtcttggtaattccgtcacctcattgcgtccgctattgatgaagtatttaaaatcaatctctcgcccacttatgccttgtgggtgttctagtagtgcggtgatagattttgcttttcgggttggataaataagctgtttcataagatgttacctcgtgaatgtgccttagctgtttacatattccataatgtccgccaatctccaacgagtggaacggccacattttttaggttgtgggaaaatgccctccttgacgtatttgtaaatagtggtgactgaatgccctgtgatagctttcacttcttgaacatcaagcaattgtttttggtgggtggtttgggttgggtttaatgtttccatcttttacgctcctttgcgttgttgtttttgtattcggggcgtattgtgttttggtggggtaaaaacttcatcgcacgcgaaaaagattttttcgttgcgaaaataacaggttgatttgaaagggttttggggaataaaaaacgcccttttgctgggcgttgatgggattatttggctttaaaaagtttattagctgtactaaagtattcttctatttttcgctgttctaaaccgattatttgcttctcttgtcgttgcgttagaatttcatcgataattgcggattgcgtccattgtttgacttttgatttcactatgcttaaaacttctcctagcaagtagagtgaattatctaggtttaaattcgtttcaggatttattttaagtctgttatagtctgcttgtaatttccgataaagttctctccctttttctaatctttcttcagcgtcttgttgtgatgatttggcttgctgtaactgaattgataatgattgtagtgccaagtcttgatctctgttttggctttctttgctctctagtagtgttcttagctcatttaacttagtttgtagattggtattttcagttaagaatttttgatattctttactcattctttcatattcaactaaatcaacaatcggctttagttcttcatcgtggaaaatagttttagggcgatcatttgggtaatgttcagaaataaaggcttttaaatctttaatccaaaaataacgtctatcataagcaacgtgatcaatcatagggtttccgttattgtcctttcttatattgcctagatagtcagtaagaatttccccaccctctccgtgttctctaacaactcttaatttaccctcatttattgccttatttagcattctagtttttttctctaaacaaggaatatatgggtgcttgtaaatgctttgtgatattcttgacgtcaattttacttcatctgataaatcattaaattttacaccacaccacaataaagccccttccgtgtatgggataagctcataatcaacgattgaacattcaggtagagaattatagtaatgttgtgtttttgccatattgttttaatctcatctacaagcggttaaattccgccaaaaatctgttatttactcaatttcaaacatcattccgcattgttcgcaataatcgccaacggcttgtaatgcttgctttcgttcttccataaattgccagcggtcatagactgcttgcgttttctctttacctattgaatggtgagctagagcaagctcagcaaccaccacgggaacgcctatactggttaaataggttctaaatatcgatctgataccgtgtgcgttttgcttgccctcgtagccgttttctcttaatgcttttgctacggtgtccttgccaatggttccgctattgctttccgtactcgggaaaatataacggctgtaaccgtatctttggcggattgtggctagtaaccgtgccatttgtgacgaaatcgggataatgtgatctatcggttgctctttcatcttcctagattgcttcattcgcttggctggaataataaaatactgctcactttcatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaataggcgttattcattgccgttaatagctcgggtaattcatcgggcataatcgcagggtgattttttgccagcggtgcaacaaaatcatcttttgcaatgttgcaattgtggctttcgataatgcctaatttaatgccgtgatccattgtggctttaatcaagcggtgtaatttatctagcgtattacttgccccaatttgagaatacagccccaccaacaatcgaggtttgatttcttccagcggtaaattgccaatgatagggaaaacgtgcctttctaaccgctcccaattcttccgcctcgtttcttcattgtgggcttttaaagggtaaatatctctaaaccaacgctcacacacatttaaaaaactgttttcttgctgcagttgtttcgcttgctcttgttctttacggtgaatttgtgggtcaatccctttggaaataagcaagcggtattcatctcgtaatgctcttgcttgtgctagtgataggttttttagctcgcctaaacttaaatcagtctgcttgcctgtatttggacgaacatacctaaaccgccatattttggaaccattttttttcaccaatagaaaaagtccctttccgtccatcatcttataatcagtttcggcaggttttgcattttgtattgtggttttatgaagctctttagcaggtcttgccatacgttctacctagctttaacgtgtttttaggggtacgttccccctaaaaaaagatttaagggtataaagtggatttcatacccctaaatatacccctaaaatttgcggttgtaaatgtataaatgcgaacgaatacgaaagaatagggaaagcagaaagtagcttgaagccttgtgcggtaaggtgctattgtatgaaaatgtaagaaaaaataagaaataaaaaaaccgctaaaaagcggtttaattgaatgttggtgccagtggtcggactcgaaccgacacgctttatgggcggcggattttgaatccgctgcgtctaccgatttcgccacactggcaagctgaatgagtgcattatagggggcttcggttaaggttgcaagtaaaaatcgtgtggtttcaatcggttgtttttattttcaacactatttcaatactaggcggtgtaaatgccgattaaaatcgaaataaagatccccattcctacatagtgattatttaaaaaggctttgaaacaggcttctcgttcacgttgtttggtgagtttgcattggtagataaataaggtagcagttagccctaatgcaataaagtaagcggttgaatagtggcttatttttccaaaaatcgtgagtaggactaatgcagttgcttgcaataaggcaatgattttattgtcgtattgagcaaataaaattgcagttgattttacaccgattcgtaaatcatcatctctatccaccattgcatattgggtgtcgtaggcaaccgtccaagcaagattagcaaaaaagagtagccaacactttaggggtaaggtttcacttaccgctccgtatgccattggaattgaccaaccaaacgccattcccagtacaaattggggtaaatgtgtgtaacgtttcataaaaggataaacagtggctaaagcaacggcaatcacagataagccaagagtataaaggtttaattgtaataccaacagaaaggcaataaaaatcagtgtggcaaagagtattttggcttcttttgctgtggctctgcctgtggcaagtggacgttgtgaagttcgttttacgttaccgtcaatatagcgatcagcataatcgttgatgacacagcctgccgcacgcatcacaattacgccaagcacaaagatgattaaaataggtaaaggcggaacgccatctgccactgcaaataacgcccataaggtcggccaaagtaataaaaaagtaccgattggcttatctaaacgcattaattgcatataagccaaccatttgtcttgactaaaatgtgatttcattcttatttttcgttacaaatatgcacagcgacatcactgtgaataagatggttttgcaattctattggcaatgggcgatcagtaaagagataattcacttctctgacatcgcctaaacgcacaatcgcattgcgagcaaatttggaatgatcggaaacaagaaccacattgcgagcatttcgcattaacgcacgtttaacttgtacttcgtggtaatcataatccatcattgaaccatcagattctaccgcactaatgcctaaaatacagtaatctaaacgaaattgattgatgaaattgacggttgcttcgccaataataccgccatcggtgcgtaaaccaccgcctgcaattgtaatttgaaaatcttctttttctttaaggatatgagcggcgtttaaattattggtgacaattcgaaggtttttatgggaaagtagtgcaaaggcaactgcttcaggggtagtgccaatgtcaataaagagtgaagcaccatcagggatcatctcagcgactttcattccgatacactctttttgcagagagaagaactgtttacgttcaatgtaatcgctattttcgctggtagaaggcgcacctgcaccgccgtgatgtcggcgaattaagctattttcggcaagttcattcagatcacgtcggattgtttgagagctcacattcaattgagcaacaagctcttccgtgctgacatagcctaattgattaaccaattcgataattttattgtggcgaatggactgtttcatttttattctcccaattcacatttgcaaaatttttcctaaaagtgaccgcttatgtagtgtgccccttgtatattaaaattatagtaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagataaacttaattagacgtatcaatctcttcaaaagatttcacgagatcatcgatcgctttcatttgtgaaacaaaggcttctaacttagacaacggaagggctgatggaccgtcgcattttgctttgttgggatctgggtgagcttctaggaataaacctgccaaaccaatcgccatacctgcacgagcaagttctgttacttgatcacgacgaccgcctgacgctgcgccaaatgggtcacggcattgtaatgagtgggtgacatcaaagatcactgggcaaccttttgacacttttttcattacgttaaaaccaagcatatccacgactaagttatcgtaaccaaagtttgtaccacggtcacataaaatcactttatcgttaccgcactcttcgattttttctacgatatttcccatttgtcctgggcttaaaaattgtggttttttcacgttgataactgcacctgtacgagccattgcttcgactaaatctgtttgacgggcaaggaatgcaggtagctggataatatcaaccacctctgcaacaggctggcattgatagatttcgtgtacgtcggtgatgattttgacaccgaatgtgtctttcaactcttggaaaatttttaaaccttcttccataccaggcccacgataagagtgaatagatgagcggtttgctttgtcgaaagaagccttaaagacatacggtacgcctaatttttgcgtaacttcgacatatttttcacagacttgcattgccatatcacggctttcaagtacgttcattcccccgaataatacgaaaggtttgttatttgcaatgtcgatattgccgagagagattgttttttgttgcataagaaatccttaataatttcgcaaactaaatatgatttccctctcccgtttacgggagagggtggagcaaattcgcagaatttgcggagggagagggctttgcaaatatttcaccaaatctaaccgcttgcgccctctctctgctaaaaatagcctcacgctatttttagctgtctctctcccgcaagcgggagagaatgtttgtatttaatgtaaaacactcgccttactctgtttctcaagccctgcaatttcaagttttaacatcattgcagaaggatcgtcagggcattgatcgataaaatagcttaaatcatcaaaagctgcttgatagcaatccatactcgctaaaatcattccacgatcacggatttcatacggatcttcaggactaatagccaatcgatattcgattaaacgcagtgcttcttcatatttaccttcacgagttaaagccattttaaataccgtttctaaccgctctaatagctcatcttcttccgctatgcgcaaatactcttggtttaattctacgccgtagcccatttccccttcgagccatttttccaatttttcacggcttagctcagagccgtcccacggattgataaatttcacttccgttctgccttgctcatttttcaattcagctcgcaaaattaattgtgtcgggaaattgaccggatatagaggtaaattcagtgaagctgctaaataaagcaccactgcccctaaagaaacaggcattccacggaatttgcgaataactttattaatcaataagttatctgtatagaaatactcggcgtgatgacaatgaaagccccattcttgataaactaaagttaatagttggtttaaacgttcttcatcactttccccattcacatcatagcgagcttttttgacaagtactgacatcaagcctaacacctgagattcagacagattatcgtcaatcatcaaggttaagcgagctaactcacggtaaagaaatttctgaagctgaactttatttaccacgcttttaggctttttaatctcttggaaaatatcgttaattatgttgtccatattgctactgttactctatcattaccgacataatcttggaatgtggtgactgcattccattgattttgttggaaaatatcttgaacactcgcagcttgttgccaaccgtgttctaacattaacgccccgttttgggttaaataaagcggtgcgttttggataattttttgcaaatcactcagcccgttttgttcggcaaccagtgcggttaatggttcaaaacgaacatcaccttgtgttaagctttcatcatctttatcaatgtagggcgggttactcacaataagatcaaagcgttgatttttcaaggcttcaaaccaatcacttggtaaaaagcggacattgtcaaattctaatttctgacgatttttttctgcaagttctactgcatcaggctgtttatctatcccaataatatccgcttttttgcctagttcacttgctaacgctaaagcaatcgcccctgtgccagtgcctaaatctaaaatatgcaatttttcttgagtcgctaaccgcttgtatgcccattccaacgcaacttcgaccaaacgttccgtatcaggacgggggattaaagttgccattgataccgccaaaggcaacgaccaaaactctttttcgcccaagatgtatgccatcggctcacctttggatcggcgagcaagtagctcggcaagttggcgtagttcgctttcgttcagttctgtttcggcaaaagcaaaaattgcagattttgaacgttttgttaccgcttgtagcagaatgttggcatcggctttggcgtttaaaaacggatcctgtgatccgttttcaagcagggtttgttcggcaaaagtgagccattgttggtaggttttactaaaaatcttcaccacttcaaaacgttcacatacgagctcaaattcatcgctaatcggttgatttaattgttgactaaaaaaatgttgatgtaacgatttccattcatccaaagagccttcgccttctgcaattgcaaaggcttcagatactttgcctaaggtattaaaagtcacttccgtcaattttattgtcactaaaggctgattttggctatctaaaatagtatgcaattcatcttgaacaggatatttatctccattttcaagggaatagaacattttgccagagcaagtcgctgtttttttaccagccagaactaatgtggctaaataatttggtgtgatgccgaattgccattgcgagtgaatttgagccatagagaatatctcaatatgggggatttctccccctaagaatagattaattctgatccgacaacgccgccaactgatccgcttgatattcggtaataatcggctgaattaactcatcaattttaccattcatcacttcgtctaaacggtaaacggtcaagttaatgcggtgatcggttacacgcccttgtgggtagttgtaagtgcggatcttgtctgaacgatcgcctgagccaagtaggttacggcgagtatctgcctgctcttgcgcttgtttttctttctcaacttggacaatgcgtgatgcaagtaccgcaagtgctttagctttgtttttgtgttgtgaacgttcgtcttgacactccaccacaatacctgttggaatgtgggtaatacgcaccgcagagtcagtggtattcacgtgctgaccacccgcccctgatgaacggtaggtatcaatacgcagatccgcagggttaatttctggcatttcgctttctggtaactcaggcattactgcaaccgtacaagcggaagtgtgaatacgcccttgcgattcggtttttggtacacgttgtacacggtgaccgccagactcgaatttgagctgtccgtaaacgccttcgccactgattttgacgataatctctttatatccgccttgttcgctttcgttagcacttagctcttcaattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttcaattctccagcgtttgctttccgcatagcggctgtacatacggtataaatcgcctgcgaaaatacctgcttcatcaccgcctgtgccagcacggatttcaaggaaacagttatattcatcattcggatctttcggtagtaataagatttgtaagttttgctcaagctgttcgatttcagctttgtttgcttcaatctcttcagctgctatctctttcatatcaggatcatcaagtaagatttgtgcttcttcgatgtcgctatgtaatttcttccaacgattaaaggtgctaaccacttcttccaactgagagtattctttggaataagcacagaatttttcttgatcgctgatgattgttgcgtcgcccaataaggcttgtagctcttcgtggcgttcgcttaggctgtctagtttattaataatagatgctttcattgttttgtttatctgtatttcaaatatcgctattgtaacggaaaatcacaatctgataaacgcaaaaaagcctagatattctctaggcttctagcaaaacactttgtaaaggaattattttactaagtcttttaatgctttacctgcaacgaatgctggaacgttagctgctgggatttcgattgcttcgttagtttttggattgcgacctgtacgagctttacggtgatttaccttgaaagtaccgaaaccgataagttgaacagaatcaccttttttaaggctttcagaaattgcgtttaaagttgcttctaatgctgctttagcatctttcttgcttaaatctgcacctgctgcgattgcatcgactaactcagttttgttcatagttttatcctctaaagatgtgtatcagttaagatggcattaattgccaaataaaattgcaaaatgcggtgtgtagcttaattcaaactgcccgattctcaaagcaaataatgcaaaaattgttagctaaatcacattttttgactaaaatttaacccaacattgctaattccactcgttctaatctcattttttaaccctaagataagttcgatgtccctttcttcgcattcattaagcaaacgataaacctgccattgcacatctaattcgtcttgaatttctggtgcatttttcagttcttgttcatttaaactgcgatcagcttgtgtttctaaataggttgccacagtcgaaagtgaaatttggctaattttaattgcctgctctaatgtttctccggcgataatactatgtaaaacttctgctaatgcttggcaagcatcttcggcagggaatacgccgtaaaaatcaaattcattcacatcaggaataatcgcttccaatttttcgagttggttctcaaaattgattttcgcccctttgacagttaaatgttcccagactaaattgagaatattttgaaaagttttagcatcatctgaccgcttactgacctcgcaaaagagttgaaagttaggcaacatacgttcgcataaacacgccataaaggtaagatgttgccaagtttcaaaacgctcgatacgtttatgaatagggtttctcattcgttatccttatttgtgatactgctgtgaaaaggcatgaacgctatccacaaacactttcggactttctatcggaacatcttgatggataccgtgtcccagattgaagacgtgtcctgagccttgcccaaagccagctaaaatcgctttgacttcttgttcgatacgttcagggcttgcataaagtacgcttggatccatattgccttgcaatgcaactttgtgtccgacacgacgacgagcatcagcaatatctaccgtccagtctaatcctactgcgtcacaacctgtgtcagcgatagcttccaaccatagaccaccaccttttgtaaataaggtcacaggcacttttcttccgtcgttttcacggattaagccatcgacgattttgtgcatatagcgtaaggaaaattcgttgtaatcacggtgtgccaatacgccaccccaagtgtcaaagaccattaccgactgagaaccagctttaatttgtgcattcaggtaaagaataacgctgtcagccagtttgtctaacagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgtagcaacgcaggctcggcatacatcatttttttgattttggtaaaggctttgctacttccaccttcaaccatataagtcgctaatgtccacgggctacccgaaaaaccaatcaatggcacttcgcctttcaactcacggcgaatggtacgcaccgcattcatcacatattgcagttcttgttcaggatcaggaataggcagatgatcgacatcggctttacgctcaatcggacgagcaaatttagggccttcccctgctccaaaacttaagcctaatcccattgcatctggaatagttaaaatatcagagaataaaattgccgcatctaacgcataacgacgtaaaggctgaatagtcacttcgcacgctaaatccgcattgcgacataacgacataaaatcccctgcttctgcacgagtcgccttatattcaggcaaataacgccctgcttgacgcatcatccaaacaggtgtcatatcaacaggttcacgcaataatgcttttaaataacgatcattttttaacattgtcatactattctctcaaaataaaaatgccctatcgggcttgatagggtaaatcatatcataaattacagggatttgacgctaatcttcacgctaacttgttcacctgattgcactaattgatgaatacgagcagtttcaacgcaaaccatcgttcgatatcccgtttcactcattccgctcattgccttatgccacgggttccaaaccactacttctctggcattttgatgttcaaccataatttgacgggaatagccaagatcttggatcagcgttggttgttggttagcacgataaatctcatcaactaattccgcaattttgcgtggcgaactaaccgcttgctgttgctgaataagggaattaaaggtctgttctggtaagccaaacaattccacctgctcaatgtttttgacattaaaataactatgtaatgccacttgtgcttcgccttgagctaaatgggtaaaacgcaactgacaagttatccctaattccatctccatttttgcttctaattgctgattttcatcaaacagactaaattcaagtttgacctgatccgcttgaacttgatagtgagatagctcccacaagcgattacgagcggtaccgtgtgggggttgttttacaccaccaaaccacggataacaaatcggcacgccaccacgaatagcattgccttgctcaaacggctcaacttcactgagccaaaaaacatcttgctcagcgtgaacaggttgccagctcaataaatgcgcaccttgtaaagccaccttcgctttcactttcgggtgagtaatttcaagcactggaatttggttgtaatcgaccaatacaagctctggggtaagttgttttgtcatatttgctccttttatatagacaaaagggatgtaacgatacatccctattcttattattgatttagattttgttttgctgcggcaatcgcttcagctacacgctctaagttcacgccgcctttggcacagcgttttgtcaaacaagagtctaacgataaaatcggataaacatcatcattaatcacagaatggaattgtttaaacttatctaaatttagctcttctaatgctttcttctggctaattgcataaactactgcttcaccaacaatgtggtgtgcctcacggaacggaataccttttgcaaccaagtaatctgcaagttctgttgcatttgcgtaaccttgctgtgcagcttctttggtacgctcagtatcgactttaatatcttctaacactaatgctgaaatattgacacacgcttgccatgtttcaatcgcatcgaaaatcccttctttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttcctgcatatctttgttgtaagccaacggcaagccttttaaagttgctaataaaccgcttaacgcaccaaacacacgcccagttttaccacgcacaagctcacaggcatcagggtttttcttctgtggcattaatgatgaacctgaagtcacacgatctgagagttcgacaaagtgagattcaccactgttaaagatgatgagatcttcggcaaaacgagaaaggtgcatcatactaatagaggccgccgctaaaagttctaaaacgtgatcacggtcagatacactgtctaagctgttgcgagtagcggtttcaaatccaagatcttgtgcgagtaaatcacggtcgattgcataagccgtacccgctaacgcccctgaacctagtgggcaagtattcattcgtttataagcatcggttaaacggctgcaatctcgttctaacatctcgtaatatgccatacaccaatgggcaaaggtgatcggctgagcccgttgtaaatgggtataacctggcattacagaaagttggttagcttctgcggtttccaccaatttttcttgtaacgcacggatagactcttgtagtgaaagcacttgggctttacaccataatttcatatctacggcaacttggtcgttacggctacgtcctgtgtgcagttttttaccgagatcgccgacttttttaatcagttttagctcaacccagctatgaatatcttccgcatcttcttgtagcacaatggctaaattaggggcaacttctgcacgcaactgctttaacgccgcaattaattcgactaattccgcttgattgatgatccctacggaatgaatggcttttgcccaaccaattgagccgtcaatatcttgtaacgccaagcggtagtcaaaacgtaatgaatcgttgaaatatttgaattgttgatctgcttgttgtgtgaaacgtccaccccaaagtgccatatccagtatcctttataaattaaattgcaaataaaaggcggtttctcaccgcttgtcttggtgattattatgcataattatgcaattaaactcaataattatttatattgagtttctatacttccatcttgtaataatattatgcaacaatctagcgactttgtaatgcatctaagcctaatattaaacttactatggaaaactttagacaaagttggtctgaaattatgagaagatacttcaataatttccttaaaattgcaaatttttgctttcattccccccccattcgctatatcattgcaagctatttcaagaacatatttattatgttgctaggtgctgaatttttagtcagctttttttttgcattttctcaatttatgccctagggggaaaacaaaaatcaatggaaaagttagagcaaaaaccaattattgagcttcgttctataacgaaacgttatggtgaaaaaacaattattgatggcttagatcttacaattaatgacggtgagtttttaaccattcttggtccgtctggctgtggtaaaacaacggtattgcgtttaattgcaggttttgaagatttaactgatggttcaattattcttgacggacaagatgtatcgaatgttgatgcagagcaacgtccagtaaatacggttttccaaagttatgcacttttccctcatatgaccatttttgataatgtcgctttcggtttgcgtatgcaaaaagtgccagaagcggaaatcaagcctcgtgtaatggaagcgttgcgtatggtgcgtttggaagaaatggcaccgcgtaagccgtcacagctttcaggaggtcagcaacaacgtattgcgattgctcgtgcggtggttaatcagccgaaagtgttattattagatgagtcgctttctgctcttgactataaattgcgtaaagaaatgcaacacgaattaaaacagttgcaacgtcaattaggtattacctttattttcgttacccacgatcaagaagaggcattaacaatgtccgatcgtattatcgtaatgaacaaaggtaagatccaacaagatggctcgcctcgtgagatctatgaagaaccaagtaacttgttcgtagcgcgttttatcggcgaaatcaatgtgtttgatgcaacggtgattgagcgtgtgacagaaaaaacggtaaaagccaatgtggagggtcgtatttgcgaaattcatacggaattacctgttcacccaaatcaaaaattgaaagtcttacttcgtccagaagatattgtgattgaagagcttgatgaaaacgaaagtgcaaaagcggtgattggacacgttagcgaccgtacttataaaggtatgacccttgagtctaatgtggtgttagatcacaaccaaatgaaagttttagttagtgagttctttaatgaagacgatccgcatatggatcactccgtaggacaaaaagtggcattaacgtggcacgaaggctgggaggttgtactcgacgatgaagactgctagtaagaaatttcaaaatattactgtagcggttatcttcggttggttaattttctttgtattaatcccgaacttactggtgttattcaccagttttatgaccaaagacagtagtaatctgattgaatttacgttttcccttgaaagctatggtcgtttgattgatccactttactcacaagtattgtggaactcgctctgtatggctgggattgcaaccattatttgtttggtggtgggctatccgtttgcctttatgattgcaaaattgcctgcgaaatatcgtccatttttgctctttttggtggtgttgccattctggacgaactcgcttatccgtatttacggaatgaagattttccttggcgttaaaggcgttctaaacaaaaccttgctatctttgggtattattagcgagccaatccgtatattaaataccgaaattgcggtgattatcggtttggtttacatattattgccttttatgattttgccactctattcttcgattgaaaaaattgatggacgtttattagaagcagcaaaagatttgggtgcaaatgcgttccaacgctttgttaaagtaattattccattaacaatgccgggaattgtggcgggttgcttattagttttgcttcctgcaatgggtatgttctatgtggcagacttattaggcggtgcgaaagtgttgcttgtaggtaatatcattaaaagtgagttccttgtcacgcgtaactggccatttggctctgcaatcagtattgcattaactgtcttgatggcattaatgatttatgtgtactaccgtgcaaataaactgatgaataagaaaatggagttagaataatgaatcgcgtattgaaaagcttttttatgtttgtcgtgtacgcattcttgtacattccaatcatcattttaatcatcaattcctttaatgctgaccgttatggtttaagctggaaaggttttagctggaactggtatgagcgtttatttaacaatgatacgctaactcaagcggcaacaaactcaattaccatagcctttttctcagcgactctcgcaacgttaatcggtgcattaacggcgattgcactctatcgctatcgtttccgtggaaaacaatttgttggtggtatgttgtttgtggtaatgatgtcacctgatattgtaatggcagtatctttacttgccttatttatgttagtcggtgtagcgttgggcttctggtctttattatttgcacatattacgttctgcttaccttatgtggttgtgacggtatcctcacgtttaaacgacttcgatgcgaaaatgttagaagcggcaaaagacttaggggcgaatgaatttaccattttgcgtaaaatcttattcccattgttgcttcctgcgattgtttcaggctggttattgagttttaccatctcgttagatgacgttgtggtttcttctttcgtaacaagtgcaagctatgaagtgttaccattgaagattttctcactggttaaaacaggggtaaccccagaagttaatgcgttagcgactattatgattgtattctcacttgcgttagtggtattaagtcagttagttctgcgtaagaaagattaatactattcacaagtacactaaagcaaaagcttaattttcatacaaaagagatcctatgtaggatctctttattttttctaaatatcgtcgttttgtattattgagtggtgccatcaaataaaggaagccaacctttagagcttacggtatgtttagggagataatgattgcgcctgaaaatatactgttctaaaatgatagtgttaaaatccacataaaattattgatgtaaaatctatttatttgagaatttaggaataataacgtgtcaaaaacaattcaagctttacgcggaatgaatgatctttccccaactgaaacaccattatggcagtgggttgaaagtaatatccgtgatattttcgcaagttatggctacacagaaatgcgtagtccgattatggaatctaccgacttattcaaacgtggtgtcggtgaagcgacagatattgtcgagaaagagatgtttacctttacccgtagcgaagaagcgggcgaaagttttacccttcgccctgaaggtacggcaggttgcgtgcgtgcggcgattgaacacggttggatttacaaccaagaacaacgcctatggtatatcggtccgatgttccgctatgagcgtccgcaaaaaggtcgttatcgtcaattccaccaagctggcgttgaaattttcgggatcccaaatgctgaagcggatgcggaattaattgtgttaaccgctcgcttatgggaaaaattaggtatccgtgaacacgtcactttacagcttaactcaatcggcggattggaagtgcgtactcgataccgtgaagctctagttgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctctagttgctttcttgcaaaatcatttagacgtattaaagcaagatcctgacagcgaacgccgtttaacaaccaacccattacgcattttggataccaaaaatcaagcgttacaagcagtattaaacgatgcaccaaaacttcacgatttcttagatgatgaatcgaaagcacattttgctaaactttgtgcaatccttgatgaaatgggtattgcctacgaagtcaatcaaaaattagtgcgtggtttggattactacaataaaaccgtatttgagtgggtcaccacagcattaggtgcgcaaggtacagtttgtggcggtggtcgctatgatggcttagttgcacaactcggcggacacgcaacggaaggtgttggctttgctatgggcttagagcgtttagtcttgttagtgcaagaagtgaacccgaatgtgcaattaccaagagctgttgatatttatgtagttcattcaggtgaaggcacaacggcagttgcattccgtttgactgaaaccttgcgtaatgcgttcccacaacttcgcacaatgctacatacaagtggtgggaatttcaaaaaacaattcaaacgtgccgataaatcaggggcgaaaattgctttggtgttaggtgaaagtgaagtcgccgagcagaaagtggtagtaaaagacctatttggtgaagcggagcaaatgaccattacccaagctgatttaatcaacgaattaacaacgcgttttgcataaggagcagaaatgagcgattatcttaataaaaccgaagaacagcagtttgaagaagcaaaaagctggtttaaagaaaatggcacaccgattgttgtggcaatttttctagttgcagcagcaacatttggctggaactactggcaaaaacaccaaattgaagtagctcaaaccacatcagccagctaccaacaagtgatggaaagctatttgcaaaatcctgaaaaaaacgcaccgcttgtacaaaaatttattgcggagaataaagactcaagttacgcggtatttgctcaactcgaagaagcaaaacaagcggcagataaaggcgattttgcgacaacaaaaacgttattaacacagtctttaggttcgacaaccgatgcaacattacaaaacgtgatccgttttcgtcttgctacagtggattatcagctaaaagagtttgatgcagcattagcaacactttctcaaatcaaagacaccgcttgggatttccgtaagcagttattaacaggtgatctgttagccgcaaaaggcgacaaggcggctgcgaaaagtgcttatgagcaagccaaagaaaaagcgggtgatgcaaatcaaatgctaattgatgtgcgtttaaataatctgtaaaaaggtaatagtggagaaatccttaatgaatgttaaggttatctgcttcttggtaattaaagaaaatagctcctagaggcagatatttcacggaattaaagttaaggtgttactgaatgctatttgtatcttctggtaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggtagtcaatgccatgtgatttttaaatgataataaccttttatagttgaattaagttctaagatactctctctttcttctccattaataaattatatttttatatataaattaaacaagtaatgcttgattttcttcgcaagaaattaccttctatgaacagagtatggaaaatgttataaagcaataatattgctatctatttatatggtatgtggatatttcatgtcaataaatctggaagattttgatgattggaggaacaaatgcaacacaaaaaaatcgcctttataggtgctggtaatatggcgtttgcgatcatttcaggattaatcaaaagcggttatcctgccgagcaaattatcgctcgtaataaaagcaatgaaactcgccgctcgcagttaagagcaatgggcgttcaggtggatttgtctaaccttgatactgtgacccaagctgacgtagtgattttggcagttaaaccgcagatgatggcggaagtgtgcagtgagtttgctcaagtggattttcgtgcaaaatgggtgatttccgttgcggctggaatttctgttgctcgtcttgagcaactgttaccaacagcaagcaacattgttcggacaatgccgaatacgccatcgctcatcggtgaaggcattgcaggattctttgcaaaaaaatcggtagatcagaccgcttgtcaatttgcagaacagctaatgtctgcggtaggtaaatgttattgggtggatacagaagcggagatcaaccaaattattgccatcacaggttctagccctgcttacctctttaagtttatggaagcaatgcaagaagctacggttaaaatgggctttagtgaacaagatgcccgttatttagtacaatcggtggctttaggagcggcaaaaatggtggtggaaaatccagaagtcaccttagcaaccttacgcgaaaatgtcacctcaaaaggcggtacaacggctcaagcattggcggtatttgaacaacgtgagctaaatgcaaccgttgaacaagcgatgaatgcggcaattaaacgtgcagaagagatggaaaaatctctatgatacaatttaccccttttcaatggtcgtcgtttaacttcttcggcttttactgtgcctatggcgtgctgttgccgtttctacctgtttggttgaaccatcacggctacgattcgggaatgattggcttgttaatcgcttcaggttatctattccgctttttaggggcaatgaccttttctaaacgcattaccctccccaaccagctactttctcttgctcgttggctaacgtggctcgccattgccactctgtttttagttgcctttggggtacaaacaatttggattttattccctgcaatcgcactgttccatatcttcaacggcggagcaatgccgatagctgataccatagcttccacttggcaacagcaagtcgggattgattatggcagaacacgtttgtttggctcgattgcctttgtggtcggctcagttagcacaggctatttagtcggctggctaggggaaagtgcgattatcggcattttgatcggctggctagtctttttaggcactggcttaacggtcaatccgacccaaacctttgtacaaacggaagaaaaagcccaatcagatttaagctatctgcaattaatgaaagtgccaaccacattcaaaatgttgattgccgtttccttaattcaatcttctcacgccgcttattatgcttatagtacgatttattgggcatcggcaggcatttcgacccaaagtgcgagtttgttatggggattggcagctgtttctgaaattctgtttttcttctttgccaaccgtgtatttaaaacgtggaaaatcagccatttaatgatcttatctgccattagctcaatggtgcgttggattttactggcttccaccaccaatatggcgatcttaatgacaatgcagatgttccattctatctcttatggagcagggcattatgcaatgatccgctacctttcaacccaacccacggaacaaatggcaaaactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagcactctattttagctttgcaagctgtatttttatggcgttgttcacctttagctcggttaatggtgttgtttgcactgcctgcgatttttatcgtgccgaagcggtttggggtgagggtttagatgaatgaatacctaacatatcaattcaataataatttaaggggctgtattagattagccacaccattttctcaacattttaagttgctcttttggtatcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagcctttttctttctgttttaaggcgtgcaaaatgagggttaaaacgatatgtttaaggacatcggcgtggttgcctgcgtgaaaactgtgatgataactcagcatttttattctctttcttgtaaaatggctctattttagcttatttagtcgttttaaactatgcagaaaacgttaaagattgaaaatggttggctgttaaataccaaacaagtaccttcaccgcactttaatccaagaccctatcaagacgatatttctcttttggtcattcattatattagcttgccccctgatgaatttggcggtgattttattgaccgtttttttgaaggcaagttagacccaacccttcacccctattttgaagagattaaagatttacgggtttccgctcactgtttaattaatcgagaagggcaaattactcaatatgtcaattttaacgatatggcttggcacgctggcgtttcttgctttgaagggcgtgaaaaatgcaatgagttttctatcgggattgagctagaaggcagtaataaccagccttttaccgaagcgcaatatcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagcgcaatatcaaaccttagctagccttacgcgagtgattatgcaagcctatccgcaaattacgcctgagcgtatcgcaggtcacaatcaaattgccccagaacgaaaaatcgaccctgggcagtattttgagtggggatattacgacttactacttaggtatattcttaagtaaacccaataaaaaacgccaataaaatcggcacaaccaaattgataataaagccgaaactgattgcaagaggcacaatctgaatacctcctgatttttgaataatcggcaatgtggcatcaagtgcggtagctccgccaagtcctacggctgttgagggaaagtgacgcataaaaaacggtatcgcaaataagcagaagatttctcttgagagatcgttgaaaaaggcaatgctaccgtccattgccccccaagcatcattgactaatacgcttgaaagggaataccaaccaaaaccagaagcaaagacaagggctttaattatcggtaaatcaagcagataagcacaaagaataccgccaatcagaccgcttgcgataaagacgacggaagtcaaaatgccacgagtatttaaaaatacatcacgcagtggaatgccactgtttctaagttgaaccccgacacagaaaatcattaccactaggacataggtgcttgaatgtaaagggaaatcaaccacatttttagttgtaaagcctaaaattactccgacaaaaaccgttgcacagagttgtgccgactcaagcaaaaccttccaacgagatggcaattcttcaaggctatgtgcctcacgtttgatcgggtaacacttatcaaaaatgagcaaacagacaatgttgcaaaggtgtagaattgcacttaaaccaaatgccgttgctccaatttgtggcagtttggtcgttaattcatctaattgcccaagcgaaattcccataatcaataaaatcaggtataagcagtaaagcgtaatgcgattgacccaattgagtatctgttgatttgtcgtttggaaaagataccctaaaaaaagtgggacaaaggcgatcattagtccgtatagcataatttctccttttgccaataaagtaaggaatgtaatggataatttaacgaagataaactgtttttatttacagtattttattgtataattaagaatacacaagcggtcagatttctctcacagtttacaaatataggcgagcaatgaattacaacaaaaaaattattcatattgatatggattgcttttatgcttctattgaaattcgcaataatccaagtttaaaaggaaagcctgttgcagtagggggaaaagctaatcaacgtggggtgctgacaacctgtaattatgaagcgcgtaaattcggcttgcatagtgcgatgtccacttctcaagcgttaaaacgttgcccgaatttaattttattgcctgtcaatatgtcgctttataaggcggtatcagagcaaattcattgcatttttcgccgttataccgacatcattgagccgatctctttagatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccgatctctttagatgaagcctacctcgatgtgaccgcttgtaagcaacattcaggctctgcaacttggatagcccaagccattcgtcaggatatttggcaagagctacaacttacttcatcagcaggtattgcaccgctgaaatttctagcaaaaatcgcttccgatcaaaataagcccaacggacaatttgttatttgccccgaagaggttgcggattttgtgaaaaccttgccgttaaagaaaatttcaggggtgggcaaagtggcccaagaaaagctggcacaacttggatttatcacctgtggcgatattcaacaagcagatcaggctttgatttatcaacagtttggtaagtttgggcaacgcttatgggatttctgtcacggcatcgatccaagagaagtcgagcctcaccgccctcgaaaatcgcttgcagtggaaaataccttactttctgatcttgatacactcactgaggcggaagatgtggtgaaatcgcactatcaaaccttactctttcggcttcaacgcaactggggcgataagccactgagcgatttaaaaaagatcggaattaaactgaaatttgatgatttcacccaaactacactagagcgaaccacagacggtatcgcagaacaccattttttacagctattacaacagatttggcaacgacgaaaggggcgaaaaattcgtttgatcggattgaatgtgcattttcctgaagaaaaaattacgaagcaattaaatttatgggaataatttttgtctaatccttgatttttgttaaataatcattatgttaagcattcggtaatcgcttattaccgaataacaacaatttattaactttggagaattatctatatgatgcgtatcgcacttttccttgcgacaaactttgcagtaatgattgtgctagggattattttaagtgttactggcattgctggaaacagtacgggtggaattttaattatgtctgtgctttttggttttgctggttctttaatctcattatttatgtcaaaaacaatggcattaaaatcagtgggagcagaaattatcactgaaccacgcaacaatgcagagcgttggttggttgaaacagtgaaacgccaatcgcaacaagcgggtattccaatgccagatgttgcaatttaccactcagctgatgtaaacgcatttgcaacaggggcaaccaaaagtaactcgctagttgcagtgagtacaggtttgttaaacacaatgacagaagacgaagcagaagcagttgtggcacacgaagtagcacatattgctaatggcgatatggtcacaatgactttattgcaaggggtattaaatacctttgttatcttcctctctcgtatgattgcaacggcagtatccagtagccgtaatgacgatggcgaagaaacccaaagtagtggcacttacttcttagtatcaatggttctggaaatacttttcggcgtattagcaaccatcattgcaatgtggttctctcgttaccgtgagttccgtgcagatgcaggctcggctcaattagtgggtaaagagaaaatgattgcggcgttgcaacgtttacaacgtgttcacgatccagaagaattacctggttcattaaatgcgatgatgattaacggtaaagcaaaagagttctttatgagccacccaccgttagaaaaacgtattgaagcgttgagaaatttatagtgagataatattattcactataatttagggtatcgaaaataatctcagccaaagatactgaaattccaggaaccgatttaatttcatcaagtgttgctgatttgacgccttgcataccaccgagatattttagcaacaaatggcggcgtttagccccaacgccagcgattgcctctaaaccactttcggtaaaggctttttgccgttttttacggtgtccgctaatggcgtggttatgggattcatcacggatatgctgaattaaatgtaacgcagggctgtcgggtggtaggtggatttccttgtcccatttgctgatcagcaaggtttctagcccagcttttcgttctacgccttttgccacgccgatgagtaatggtttggatttatcccattccactttgagattggcaaaggtgtctaaggctcgatttaactgcccttttccgccgtcaataaaaataatatcagggattttttcaggcggtagcggtttatcataacgtttgagcagggcttgttccattgcggcataatcatcgccccctgtaataccttcaatgttgaaacggcgatagtcggattttaacggtccattttcatcaaacaccacacaagaagcgaccgtttgttcgcccatcgtatgactgatgtcgaaacattccattcttgcaatttttggcaaagaaagcaccgcttgtaaagcttcataacgggtttggattcgagcatcttgcttgagctgtaaggtcaatgctgccattgcgttcgttttggcaagcgcaagataacggcttttttcaccacgcactttatcggtaatgctcactttatgccctgcttgttccgataataccttttctaaggcgtccacttcgctcacggagtgatcgataataatttgatgcggaatggtgcgatgttggttcatctgcaaatagaattgcccgataaaagtgtcactcaattcggcaagttcggtatggttcggcacttttgggaaataacttcggctacccaacattttcccttgtcgtacaaacagaatatgtacgcaagcgataccgtgttggtaggcaatcgaaataatatcgagatcgtctagacgttcattcgatacaaattgcttttcagtgaccactcgcatctgctgaatttgatctcgaaaacgggcagcagcttcaaaatccagatcttccgcagctttttccattttaccgatcaaatgttcgatcacttgctgatctttgccttgtaagaataagcggacatattccacctgttgatcgtattctcgttgggaataaacgccttccacgcaaggggcaaggcaacgcccgatttgatattgtaaacaagggcgagaacggtttttgtagtagctgtcttcacactggcggatcggaaacagtttttgtagcagatttaaggtttcccgcaccgcccctgcatttgggtaaggtccaaaatattcccctgcgatttttttacttccccgaaagctggctaaacgtgggtgctggtgtttggtgagcaaaatataagggtaagatttatcatcacgaagcaacacattgtatttcggttgattttccttaatgtaattgtgttccaacagtaaggcttcggtttccgaatgggtaatggtggtatcaatatgagcaatttgcgataccaaggcttcagtttttcggctggcaagagtgctacgaaaatagctcgatagacgcttttttaagtcttttgccttaccgacatagatgatcgtgcctttatcatcatacatacgataaacaccagggttatgtggcgtatcggcaagaaattgtttggaattgaattttgacataggattgtagggacacactgcgtgtgtccgctgaatatcgtttttgcgtaaaataaagattagacggacacacgcagtgtgtccctacaaagtatttaagattttaataaacttcctttagatgctttcaagtattgcaacatcgaccaaatggttaaaatcgcggcgatatagagcaaagcaaaggcggtatattccatccacggtgcttgtcgccataacaaaccacccaacgccaacatttgtgcagtcgttttcactttcccccaaatagacaccgcaacacttgcacgttcacctaattccgccatccactcacgcaacgccgaaataataatctcacgggcaatcataatgcctgcaggaatagtgatccaccaagtatggtagtattcgaccacagacaccaatgcaatcgcgattaaaactttatctgccacaggatctaaaaatgcccctaagcgagtagtttggttccacttgcgagccaaatagccgtcaaaccagtcggtgattgaagcaataaaaaaaatcaacgtggtaatttcagcagaatattgaataggtaagtaaaaccaaacaataaacagcggaattaacgccacacgaaataaagtcagataggtcggaatgttgagtttcatacgttacaggtcgaataaagatattccctatattctattataaagtagatgaaagaagaaagcgataatgccataactcttattatttttctaaatagatagataaaaagaataaatattgtagaatacggactatgatagtgaatgaaatgttaatattttctttttcccaacaagaacttaatgccatttatttaagcctaaaaattgccagtatagcggtcttatttgcgttgccttttgccattggggctgcgtggttgttggctcgaaaagagttttggggtaagcatttatttaatggcattatccatttgccgttagtcttgccccctgtggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcggttatcttttgctgattttaatggcaaagaaaggggcgattgggcaatatttgtggcagtggtttgagttttcgttaagtttttcttggaaaggggcggtgcttgcttcaatggtaatggcttttccgttgatggttcgctctattaggttagcctttgatgctattgatccaaaattggagcaggcggcgagaaccttaggggcaagtccattaagagtgttttttacacttcatcttccgctctctttttcggggattattgcaggggcggtgttaggttttgctcgttcgttaggggaatttggggcgaccattacttttgtgtccaatatccctaatcaaacccaaactattcctgcggcactttatacgtttattgaaacccctgacggtgaaatggcggttgctcggctttgtgtgattgcgattgtgatttcgttagtggcgttatttttttctgagttattgtcacaacgtcagcaacgtttccaacaaattaagggacagtaatggcacaatctttgcaacttaaagttaaacatcgtttaggaaacttggatttagctgttgatgtggcgttaaatgctaaaggggtgacggcaatttttggtcgctctggggcagggaagtcgagtttaattaatcttatcgcagggctagttacaccaacggaagggcgaattgtgttaaatgggcgagtgttgtttgatgatcgccagaagataaatttgccgcctgaaaaacgtaaggtgggctatgttttccaagaacatcgcttatttccgcattatcgagttgaggcgaatttaaaatatggctgtaagcggtttgatcaggcgaatttttcacaattagttaaattgttggggattgaacatctgttagatcgtttcccgatcagcttgtctggtggtgaaaaacaacgtgtggcgattgggcgtgcgttgttgagcgagccagatattttgttgatggacgagcctctttcagctttagatttaccgcgtaagaatgagttgatggactatttggggcggttggcaaaaacggtggatattccgattttgtatgtaagccatagccttgatgaggttattcgtttggcggataatttgttgttgttggaagaggggaaggtggttgcttttgataaaacgttgaatgtttggcatagcccagccttttctgcgtggcagcctgaagctcaacggttgagtttacttgagctgcctgttgtcgctcaaaatccttaccgtatgcaagggctggcattgggacaacagttaatttgggttacggaacagcctcgctatcaattaggggatttaatgcgaattagcattggtagccaaaatgtttctattaccctgtctaaacctgagcaaagttctattcggaatattctgcaagggcgaatttgtaaaatcgagcctcaatctgaccgctatgatattgccgttgaggtggaagctcaagaaatttgggcgagtatcagtttgtgggcgtttgatgatctgtgcttgcaaatagggcagatggcgtatttgcaggttaagagtgtggtgatttagattagattcttaatttttctatatatttgaatggtattttttatttaccaagctataaaggagtttgataagcaacaaggctacatttaaaaatagctattacgaggtcgctgtaatttgcgatagatcaaaaaaatatatattatcttcttattatttgttactatagttgagagtttacactcaattgttactgattatttttgaggaacataatatggcatacacattacctgagttagattatacctatgatgcattagatccgtattttgatgcaagaacaatggagattcatcactccaaacaccatcaaacctatattaataatgcaaatatcgcattagaggcatatcctgatttactaggacaatgtccaggaaagctgatctcaaatcttgagcaagttcctgtagaaaaacgagtagctgtgcgtaacaatgtaggaggacatgttaatcacacgttgttttggaaagggttaaaaactggtacgaccttacaaggaaaactcaaagagaccataatacgggattttggttctgttgaaacattccaagaacaatttgagctggctgctaccactcgttttggttctggatgggcgtggctagtactagaagatggaaagttatctgtagtatcgacagctaaccaagattctccgttaatgggtaaagatgtagctggtgtgtctggttatccaattttaggtttagatgtatgggaacatgcatattacttaagttaccagaaccgtcgtcctgattatattaaagcattttggaatgtggtgaattgggacgaagcagccagacgttttgaatcccaagcataacgcaactgtgagtagtgtatggttgctaatgaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctttttctaccttgatacccattcgggtgtggggcgttatagcttgcaaagtagcgaagcggaaaaaacaggggaatatattgaaggtatagctcgcctttgggagagaaccgatctccccgaagaagttgtcttgtacctaaatgaaatcaaaaaaattaacaaagataagctacgtttttacgcaggctcgccgttacttgccgtgcaacaattacgtccacaggacagagcgttactcacagagttacaccctaacgacttcccactacttcgcaatgaatttgccaaaacacctaatgtggtgacaaaacgtgaaaacggttttcagcagttaaaatctgccttaccgccaaaagaaaagcgtggtttggtgctgatcgatccgccttatgaattaaaagaagattatgaactggtggtaaaagccattgaagaaggctacaaacgctttgccacaggcgtttatgcgatttggtatcctgtggtgcttcgccaacataccaaacgtatcgtaagaggcctagttgaaacggggatccgcaaaattttacagattgaattagccgttcgccctgactcagaccaacgaggtatgactgcaagcggtatgattgtaattaatccaccgtggcagttagaaagtcaaatgaaaaagattttaccctatttaactgatgtgcttgtgccagaaggaacaggcagttggacggtagagtggattacgcctgagtagatatatcaaataagtataaggaaactaacaatgcaacaatacaaacacgactttatcgaatttgccttaagccgaaatgtacttaaattcggcgaatttaccctgaaatcaggcagacaaagcccttacttctttaatgcaggattatttaatactggcagagatcttgccaaattgggcgaatattacgccaaagcgatccaagctagccaaattgactatgatgtactattcggacctgcttacaaaggcattccgattgcaactactgtcgcggtggcattagcaaatcaatttgatgtagataagccttgttgctttaaccgtaaagaagttaaagatcacggcgaaggtggaaatcttatcggtagcccgttaaaaggcagaattttattggtggacgatgtaattaccgcaggcacggcaattcgtgaatcaatggaaatcattcaagccaacaatgcaaccttagcgggtgtgatgatcgcgttaaaccgtaaagaaaaaggcaaaagcgaactctcagcaatccaagaagtagaacgtgattacggctgtcaggttttctctattattgattttgatgatcttgttagcttcttagaaagatcagcgcaatatactgactatttgccaaaaatgagagaatatcgcgagaagtatggtattaaataatcggtttaaaatttaacaatatactgaaagattgttgttttgcgtctatttttgtaaatattagtgactattttatgtaagcaactttttaaggcatagtagacaaaatggtcactatgcctattacaggcgtaatagataaatttgttgctaaaaagtagcttaaagccttatagtacaagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagaaaaagttttatgacattcattacaaaaataacgttgaatattatttcttataccatgtttgcggatatcgctactgtggcaaactagctataataaaaacggcactttaagtgccgtttctatttctatggttaagatcttttcataatctcaaaaaactcatcgttggtttttgcgaccatcaatttatcaataaggaactccattgcttccacttcacccattgggttaaggattttgcgtaaaatccacattttttgtaattcatctgggcttgtgagtagatcttctttacgcgtgcctgaacggttaaagtcaatcgctgggaatacacggcgttctgcaattttgcgagaaaggtgtaattccatattacctgttcctttgaactcttcaaagataacttcgtccatttttgaacctgtatccacaagtgccgttgcaataatggttaagctaccgccttcttctacgttacgagcagcaccaaagaaacgttttgggcggtgtaaagcgttagcgtccacaccaccagaaagaattttaccagacgcgggggttactgtgttgtaagctcgtgctaaacgtgtgatagagtctaataaaataaccacatcttttttatgttcgactaaacgtttcgctttttcaattaccatttcggcaacttgaacgtggcgagttgcaggttcatcaaaggttgaagcaattacttcgcctttcacagaacgttgcatttcagttacttcttccgggcgttcatcaattaataaaacaattaattcgcactcaggatagttatgggtaatgctttgagcaatgttttgaagtaaaacggttttaccggcttttggcggtgctacgatcaaaccacgctgacctttaccgattggtgaagccaaatctaagatacgcgcagttaaatcttcttttgaaccattaccacgctccatacgcaaacgtgagttagcgtgaagtggcgttaagttttcaaagagaattttgctacgagaaacttcaggtttgtcatcattaactaaatctacttttagcaatgcaaagtaacgttcgccttcttttggtgggcggattttaccttcgattttgtcaccggtttgaagattgaaacggcggatttgacttggggaaacgtagatatcatcagggcctgcaaggtaagaactatcggcagaacggaggaaaccaaaaccatcaggtaagatttctaacacgccttgaccgaaaatgtcttcaccactttttgcgtgttgtttcaaaatggcaaagataatatcttgtttgcgtaagcgagctaagttttctagccccatttgttcttcaccgatacggacaagttccgatacgggtgtattttttaactctgtaagatgcatagaaataataattgtgttatttaaagattggattaaaacaggttaattcagatttgtttgtatgaattgtggtggcggagaatacagcgaaaaggaaaattttgcaaattttttctgccttattaccgcttgtttgtgtgaaaaagggtaaaatagttgaaaaaaaggggaaaaatggctgataatatcaatgaagttcgcttggataagtggctatgggcggcacgcttttacaaaactcgttcaattgcaaaggcgatgattgaaggtggtaaagtccattacaatgggcagcgggctaaaaccagtaaaatggttgaagtgggggcaacgattaaattacgccaaggcaacgatgaaaaagaagttgttgtcacagccttgagtgatcaacgtcgtggtgcacctgaagcacaactgctttatcaagaaacggaaaaaagtatccaagaacgagaaaaaatcgcctttgcccgtaaagcaaatgcgttatcaatgccacacccagatcgtcgcccaaataaaaaagagcgacgggatttgattaaatttaaatatcaagagaacgatttgtaattacttaaatcgtccccatatagcttttgtaatggcggtgatttttctcaccgcttgtattttatgaaggatttttaatgacaacttacacacaagataacgataaactttatcgctttttatttcaaaaccgtgcggtgcgtggagaatgggttcgcttaaatgacacctttacggaaaccttaaatacccaccactatccatcagcagtacaaaatttgctaggtgaaatgttggtagcaaccagtttattaacggcaacactcaaatttgaagggacaattgccgttcaaattcaaggtgacggagcgttaaaattagcggtggtaaacggcaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaacaacaatttcgtgctttagctcgtgttgaaggtgatattgcggataacgcaacacttgctgaaatggttggaaatggtgttctcgttatttcgattattccagaaaaaggtgaacgttatcaaggggttatagtcttagataaacctactgttagtgagtgtttagaagactattttgctcgttcagaacagctcgccacacagcttgtgatccgtgttggtgaatatcaaggcaaagccgttgctggtggaacattactacagatcgtgccagatggcactggttcaccagacgactttgagcatttggcgacattaacttcgacgatcaaagatgaagagctatttggtttaacggcagaagaactgctctatcgtttattccacgaagaaacagtggaagtttatcaaccgcagtccacagaatttaaatgtggttgctcaagagagcgttcaggagcggcaattttgttactgcctgaagaagacattgcagagatgttatccgaaaaacagggggtaattgatatgcagtgtgaatgttgtggtgcgcaatatttcttcgaccaaaaagcgattgatgaattaaaaacggatagttaatttgaagcacaagcggtaagatatgtaaaacattttgcaaatcctaccgcttgtaacttaggaaaatacaatgagcaaacaacaaatattacgccaagttgtactcgatactgaaactacgggaatgaatttcaatggtgctccacacattgggcataacatcattgaaattggtgctgtcgaagtaattaaccgccgtttaactgggcggacttttcacgtttatatcaaaccgccaagagaagtcgaggcagaggcaatgcaagttcacggtattaccaacgaaatgttggcggataagcctgcatttgctgaaattgccgatgagtttattgaatttatcaaaggggcagagctgattatccataatgcccccttcgacgtaggatttattgaccacgagttttccttcttgccaaatccccctgaaaaagtggcacagatgtgtaccgtcacggacagcttgcaacttgctcgtaagatgtatccagggaaacgtaacaatttagatgcgttatgtgaccgcttggggattgataacagtaaacgtgtcctgcacggtgcattactggatgcggagatcttagctgatgtgttcctgatgatgacaggcggtcaaattgcccttattggtgaagatgaacacgagcaagcaaaaacatcttcagtagagcaagtttaccagccgttaaatatcgacacctctaacttgattgtcttagcccctgacgaagaagaattagcagaacatcttaaatatcttgagttgataaataaaaaatcaaaaggaaattgcctttggacgagagaattggcgacagaaaacacgacattgaattaaaaagagagcgttttgtatagtaaaaagacaatcaataaattttttcaaaaaagtgtttgacggtagagaacgaaatcattaatatacgcctcgtttgctgcggagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattccgccaactaatttaagaaacatataaaaagccaatcatatatctatgattggctttttatttagactatctatacgtagtaacagatataggtgtaatagacaaattttatttatacatcataagtcgtcgatgccgtatttccaccacgtcccgtccagttggtatggaagaactcgccacgtggtttgtcggtacgctcataagtatgtgcaccgaagtagtcacgttgggcttgaagtaagtttgctggcactcgctcagaggtataaccgtctaagaaagtgattgcacttgccatacaaggcatcgggatacccacttcgatagatttcgctaccactttacgccagtcgcttaatgcgttttctaaaatgcctttgaagtacgcatctgaacctaagaacactaaatctgggttcgcttcgtaagcatcacgaatgttgcctaagaaacggctacgaatgatacaaccttcacgccataataacgctgttgcaccgtagttgatgtcccaaccgaagttttcagacgcttcacgaataagcataaagccttgtgcgtaagagataatttttgatgctaataacgctttacgcaccgcttcgatccaaacttgtttgtcgccttcaactttgccaatggttttgttgaacaatttagatgcagcaacacgttgatctttgaatgaagatacacaacgagcaaacactgactcagtgattaaggttaatggaataccgaaatctaatgcattgatccccgtccatttacctgtacctttttgacctgcggtatcaaggattttttctactaatggtgtgccgtctgtatctttgtaacctagaatatcagtcgtgatgtcgattaagtaactgtcaagttcagtttttttccattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaatcaaatcgctggcttgtaatggcacggatttttccagcatctccgctttgacgatactctggtcttggcttgccaacaagcggtcgtaataaagcgtagaaatgttacgatcaagagttcttaccgaccaattattttcagcggcctcttttagataataaagacgagctttgtcgtttgatacctttaatgaacgctgaaaatgagaccacgataattgtgcgaacaccgttcgcacttttggaaaatcaggaaataaaacatagaattgtcgcatttcccacaggctacgtttactaaaacctttgccaaactcattcgttaattcaacagaaagattttttataatctctttcccataagctgcccgatcagctccattttgttcttccaacacaatacgttcaccaattttccaataggcttcaaccattgctgaattgacagcggtataagccttttggcgtgcattggcgagaatttgtttaatttctaaaagataactgctgttgattaagtccatattgagctccgataatcgcttaaaaattaagctatatttttacaacaacttcgccgcatcgctatccaaataccactcagtcacgccatttttggctttaatttttgccgctgggtaaggcaggttttccgctggtgttgtttggatttctttgagaatttctgttttacttgcccctgtgaccaaataagtcactcgttttgcctgttcaatcaatttggcagttttggaaatacgaatttgccctgtttcagggtgtttggcaataaccgctaaatttcgatcattgaaatttgtttgatgtgggaatagggaggcggtatgtccgtctgttcccatacctaaaataatccaatcaaactcgccattaggtacacaagcggtcagttcttgtgaaaatcttaccagttcttgctccacaggctcttcaccacgaatacggtggatattttccgttgggatttgaatatgatcgaacagtaatttttgtacttcaccataattgctttcaggatcttgtggcggaaccatacggtcatcgccccaccaaaaatggagattttgccattgaatttggcttttatacggctcttgcgcaagggttttaaacagcagttttggcgtgcttccgcctgatagggaaatatgtacggggcggttttgttcactataagccttaaattcttcggcgattttctcaacagcattttgagcggtgttaaaaataattgtgttcatttcactttccttaaaatcccccttaatccccctttttcaaagggggaaatttatgaggaatagatgatcttgtatttatttccccctctttgaaaaagagggggcagggggagatttaaacttttttcttcatcaaaccgcttggtttacgccacacttcgccgtgtttggcgatcaatttatcggcttcagaaggcccccaagtacctgcttcgtattcataaatacgcccacgttccgctttatagtccaaaatcggttgaacaaatctccagcaggcgtgtactgcatcggtacgagcgaatagggttgcatcgcctttcattgcatctaataatagacgttcataagccgttaataggcttggtgaagcaagatcggcatagcggaaatccattgatacttctttcgcttcaaagccagcaccaggttttttcaagccgaaacgcattgaaatgccttcgtcgggttggatacgaataatcaatttattatcaggggcattttgactaaagactgggtgtggggtggttttaaagtgaataaccacttctgtaacacgagctggtagacgttttcctgttcgtacatagaatggcacaccagcccaacgccagttgtcaatttggcaacgtactgccatataggtttcagtgttagagtcttcaggcacacctttttcttgtagatagcctttaacttcttcgccgttaatggtgcttgcggtatattgtcctaaaacaaggttatttttaatatcatcatttgaaagtggatgcagacaatgtagtactttcgctacttcatcacgcattgaatcggcattaataatcgcaggtggctccattgcgaccattgctaacacttgcaataaatggttttggaacatatcacgcattgcacctgagccatcataataaccgccacgatcttctacaccaatagattctgcccctgtgatttcaacataatcgataaaattacggttccagagcggttcaaatagaccattagaaaaacgcaaaacgagcaaattttgaacggtttctttgcctaaataatggtcgatacggtagatctgatgctcttcaaaatacttgtgaatttgaatatcaagggcttttgccgtttcaatatcgtagccgaaaggcttctcaacaatgatccgtttccagccaaattcttctgttgttaaaccgtgtgctgaaaggcattcagggataacgccgtataaactgggtggcgtagaaagataatatagcgtattaccgcctgtgccatatttgtcgtgcagttcatctaaacgtggcaataattttgcataatccactgcatcagacgtatttaccgattgataataaaggtgttcgcaaaatttttctaacacatcaccgcttgcattttcaagtttgactaaggtgtcgtgcattttttgacgaaaagtttcatcggtcaaaggggaacgagcgacccctaatacagaaaaatgttcagaaagtctgccgattttataaagattataaagggctggaattaacttgcggtaggtgagatccccagacgcaccaaaaatcacaatacaattattgtctgctttcatttgcaatcctagaaaatgtaaaaaaattgttagatttcataacaaaatataacaataaataaaatcaattaaaagaaaaaatctgttgccaatcacgttgtttatttgccaccattataaaataagggtttacaaaggtttcacgttgattatagcttaacggttggaagtgaagatcgaagacctgaccgcctgtttctgcgagtaacacttcagcaacagccgtatcccattctccagtatcccctaaacgcacatagcaatccgccttaccttcagcaaccaacccagcttttaagctacttgaaccgaattgaagaaaatctacttgataagggggaagcacagcttggcgaattttgtcgctacttgacgtaccaatagtcacttgcaagcggtgtgatttatcgtcattttggctattcgaattaagacgatggatctcgccattttctctaacaaaagcaccgcttgcacgcattgcatagtaggttttgtctaagatcggcgaatgaatgacacccagaacagggcgattttgctgaaccaacccaatcacaactgaaaattgatctgttctatcaataaattgctgtgttccatcaagtggatcgacgatccaatattcttgccattgcgaacgctccgaaagtggaattttacagttctcttctgacaagatcggcacatttggggtcaatttctgtaattgttcaatcacaaactggctaataaaaagatcagcttcagtcacaggggttttatctgctttaatctgaatttccacagaacgctgataaaagcgtttgagatgctctcctgcttgaacggcaatattaaggacatcatttaatagttgttgagtaagtgtttgcatataaaactccttaatttatctctcaataataccgcacaatgtgttgaaagccaaaggttattgatcggctaatagacattggccgctagcttacaacatttgtgttttatatctagggtttaaagggtaaaggtaaatacatgattcttatacaaggataaatcccctagtttgtcatcctcctagatttcgctataatgctccgcttttaaaactacaaggaataactatgtttgaactcaatccgattagaacccaattagatgatttagccgaacgaacccgtacacttcgggggtatctttgacttcgatctgaaagccgaacgcttagaagaagtcaatgctgaattagaacagccagatgtctggaataatgctgaaaaagctcaggcgttaggcaaagaacgtgttgctcttgaaactattgtgaatacgattaaagcccttgagcaaggcattgaagatgtcgaaggcttgattgagcttgccgttgaagcggaagatgaagaaacttttaacgaagctcaacaagaagctaaccagttagaagaaaaattagccctgttggagtttcgtcgtatgtttagcggtcagcacgatgcggccgattgctatgtggatttacaagctggctcaggcggtacagaagcgcaagactggacagaaatgctactgcgtatgtatttacgttgggcagaaagcaaaggctttaaaaccgagttgatcgaagtatccgatggcgatgtggcaggattaaaatcggcgacaattcgtgtgtcaggcgaatatgctttcggttggcttcgtacggaaacagggatccaccgtttagtgcgtaaaagtccgtttgactccaataaccgccgtcacacctcttttgcagcagcctttgtctatcctgaagttgatgatgattttgacattgaaatcaaccctgccgatctacgtattgacgtgtatcgtgcttctggtgcaggcggtcagcacgttaataaaacggagtctgcagtgcgtattacccatatgccatcaggtattgtggtgcagtgtcaaaatggacgttcacaacatcaaaacaaagatcaggcaatgaaacagctcaaagcgaagctctacgaagtggaaatgatgaagaaaaacgcagaaaaacaagcaatggaagagagtaagtctgatattggttggggcagtcaaatccgttcttatgtgctagatgattcgcgtatcaaagatttgcgtacaggcgttgaaaaccgtaacacacaagctgtgttagatggtgatttagacaagtttattgaagcgagtttgaaagctgggttataaaagatgcgcattagatttactggattctagtagaaatccccgttctgaagaatggggaaaactttggatgctagagagattatgatattttaattcgtcgcaataatcactgcccttttcggtgcaggatacccttctatcgttttggaatgatcttgagggtcgaggaaatcaaccaacgattcattttctaaccaatctgttttacgctgttcttctaatgtggtgacggcttcatcaacacaacgaacatttttaaagccaactttttcaagccaattaatcaacgctggtacagacgggataaaatacacatttttcattttggcataacggtctgctggcaccagcacatcattaatatcaccgtcgataaccaaagtttctaacaccagctctccccctttgactaactgatttttcagttgggcaagatggtctagcggcgatttacggtgatacaacacccccatcgaaaataccgtatcaaaggcttgcaagggttgcatttgctcaatgcctaacggaattaaattggctctgcggtcgttatttaacaattttcgcaccgcttcaaattggcacaaaaagagttccgtcgggtcgatccccaccaccatttttgccccttcgcccaccattcgccacatatggtagccactgccgcagcccacatctaaaatcaagcggtcttttaacggtgataaatggggcaaaaccctatcccatttaaaatcggaacgccattcacaatcaatatgtacaccatacagatggtaaggaccttttcgccacggcataagctgttttaggtgatgtaccaagcgttgcgtttcacctgcagacaacggctcagccaaacgagcttcaaccttatctgccaaattaacttcacaaggcaagctaggtaaatggtctagcatttttgcccatttggcataatcgccgtgcgtctgtttttcccattgtttgagctgtaaaggaagtgtttccaaccaagcagataacggcgaggtggcaatttgttgataaaaaggacgaaaatcaatcataatcttttcaaataaagtaaataagcggcgagattttaatgaaaattttcttgataagcaaaaacacttacctaaaaatagtcaaaaaagtacaagtatcatctacaatcttgattcaatattgtcattttcaaaaatttcgagtagaatgctcactctttttggtgctaggcttctgcctagttttttattcatacatatggtactagacagctgagtagtatgctctagtggcgatatggcttcgttagaggttttctataatgaaacaaggtattcacccaaattatgtagaaattactgcaacttgttcttgcggtaacgtgatcaaaactcgctcaacagcgggtaaagatttaaacttagacgtatgtggcaactgccacccgttctacactggtaaacaacgtgttgttgatactggtggtcgtgttgaacgcttcaacaaacgcttcagcattccaagcacaaaataatttgaaatttttcgggaaaacctccacaatagtggaggtttttttatgcctaaagaatgtatccagtaaaatgctgctctggcaatgatatgataattaggaaagcaataatgaatcaaaagcaagatcttcaaattatatcaatacttgggcaaactcaaatcggatataccaaaccatttgaagattatttaaaacatataacacaaatattaaaaagaatagaaaatgatgaattttgggaggaatttaaatgaatgaaggattactatatagttttatccgctaccgcccttatattgaaacagaagaatttgctaatgttggtatcttaatctgtaatccagataaaaaagaattaaaatatcgtttagtagaagccaacaatgaaagagtaaatcacttttttaataaacaaaaaaatttcaatattatccgagatgttttgaataatgaattggattacattacccatcaatcttttgatctcaaagataatgatgaaatgattagatttttctataactataccgatagaaaagaaggagttatccaatatagctctccaaaaatattggtgtctgataattcagagatggaattggatagactattttctagttatatctaactcattcattgtattattgataccgatggtaaccctgaacgtttcaagcacaaaatgatttgaaatttttcgaaaaaagctccacaataatgtagtttttttatgtttgaaaattacgctaagattatgttagatactgaattacttgctttgatacaaaaaggggaaggtagcaaattacagtttaaagctaatgttactcaccctgatgctttagccgctgagatggttgcttttgcaaactcgctaggaggaatcttacttattggcgtaaatgataatggtacattaagtggtctaactaatgatgatgtatttaggcttaatcaacttattgctaatgtcgcatctcaaaatgtccatccatcaatttctccacttactgaaaatattacctttccagatggaattgttatcgtcgtccatatttccgagggaattagcaagccatatatggattctcagggctatttttggacaaaaagtggagccgataaacgtaaaataacagctcgagaagaattattaagaatgtttcgtgaagcttcccttgtacacgcagatgaattacctgttactgggtcatctattcaagatcttgatgaagtttattttgatcacttttttgagaagttttatggtgaacccgtaactagccaacatttttctaaagctcaattacttgaaaatatgaatgtaatgaaaaagggtgaatttaatatttgcggagcgttattatttactaaagatccaagtagatatttaccaacatttatcataaaagctgtttcatttctaggaaatgatattacggaacaacactatattgatagtaaagacattcgaggtaatatcacggaacagttccgccaagccataagttttatcttaaccaatattcagcacaaacaaaatggacaaagttttaactctcttggagaacctgaaataccaagaattgtgtttgaagaactgattgctaatgcgatcattcatcgagattattttatttctgctccaatccgaattttaatatttaatgatcgtattgagattattagccctgggcatttgccgaataatcttacaattgaaaatataaaactaggtaactccaatatacgaaacccgattctcgcctctttcgctcctagagcacttccttatagagggctaggaagtggtatattaagagtattaaaagagtatcctaatgttgaatttattgacgatcggattgggaatgtgtttagggttgtggtaagaagagaattagctgtaataatcaaaaaataagattttttcatctataaaatataaggataagattacaagtaaaataatgggatcatggtaaatgattttttgtaaaaactttactaattttatgaatttaaatatgagagatttttataattgaaaaaattaataaatcattgaaaacgggatttaccatccccttgaaatttaataatataatccaatctcaaatgagagaagtgcctacgatagatagtgtagcttctcaaaaatgaaatttatatttagaggatcttatgcatctccctttagtctcagttttaatttgtgcttataatacggaaaaatatattgaacagtgtataaactctgtaataaatcaaacatatactaatttagaaatagttattgtagatgatggttctacagataatacaaaacatatcatagaaaagttagctaatcaagataatagaattagtatcataaataatgaaatgaacattggatatatatcttcattaaataaagggatacaacatataaaaggagaatatattgctaaaatagattctgatgatgtagccaaacctgattggattaaaaacattttagagaaaatgttggaagatcctacaattattgcaatgggttgctatctagaaatcatatctgtcaatggaaagctgggtaaatactataaaacaggagatatttggaaaaatgcactaacagatgctcatattaagaatgatatgttattctataatcctattcataataatacaatgattatgaaaagtttagtacataaaaaatatggtttaatatatgatcttaattatatacatgctgaagattataaattctggtttgaagtaagtaagttaggaaagatggcaaattatcctgaagctctagtttattatagattacattcagaacaaacatcatcaaatcataatgcctcacaaataaatactgcaaaaaaaattagacgagagattattacctactatatggaaaatctaggcttcgttaatataatagattttgataatatcaaatttagtgtacttaataagctcttgctggaaaaagatgtttggaatagactaacttataaagatatagaaaatcttaaaaaaatattattcgattgctttatgtctgcaaaagtagattcatacaccatatgcagaaccatttttactagtaatgccaaatgttttacttttaaacaaaaaattaagataataaaaaaaatgcttagaccatataaatatataagtaatatataataggagttatagatgaatattgttttttgttgcgatgaaaaatattccccctatcttgcagtaaatatattaagcattctaaaccatcataaaattatgattaatttttatgtattggatttaggtatatctagtgaaagtaaagaatgtattataaacatagtagataatcatagatgctctatagagtttattcctataaatgaagatgattttagtgaatttccccaaacaatttcacatatctctaaaacgacatatgcaagattaaaaatagctgattatgtaaagaatgtagataaagttatttatctagatatagacttattaatagcaggtagcattattgatttatggaatataaatctagataaatatcatattgcggcttgttttgattcatttgttgaatatggtttggataattataaagcaaaaataggctttgatgaatctaatagttactttaacgctggagtattattaatagatcttaataagttaaaaaattttgatttatatactaaagccatagtatgtataaaagaatatccatatattgaatttcaagatcaggatattttgaatattatttttaaaaataaggttaagataattaacaccaaatataatttccaaccttaccttagatatcgaatattaaaaaaacagcaattgagtgatcaagaaagaccaaatttcccaatctctattttccattattgtggtgaagataagccttggcatagtaaatgcaatcatactaagtctcaattatttattaagctatttaattcaattaataataaaccacaacattggttaaataaggtagctcagaatgattatcgccaaattttcaagaaattaaaaaatgattttaaagatcgaataaaatttgggatatactaataaaaaacacacaaaaaaaagaatacctcaagccttatagtaaaagacttgaggtttaatgttattcaaaaggaataatacttttctgattttctagctctatctcttctattctctgttttttgcgtttatctctatttttatatctatctaattcttttagaatcttacctaatatactcattttttctttaggcttagttataaaacgttttgctctatcttcttcaatttgactatataatgagctttcttctttattcaattgtagttcttgaatacaaatagcaggagataattgatatataaataagttctgatctgataacaattgattaaaaattatttgatctataggcttaatatcttctgcttccaaggatttaattaatcttaataaataattaattgcatttttagaaataatatatcctgccgtaccataatgtttagatttaagaatacatatatttctaccattaataggagcaatattttgagctttttcactgattacaggcatcaaaaatgtttcaaaacgtactataaaattatcttgtttaatcatagaacctgaaatccaagaatagtcatttagaaaatattccgcatcttcacttaagataacatcatcttcaaaaatactaatgtaaggcatatcttcatcaatacacttttgccatagtaataaatggcttataagacaacctttctctccaactgtgagaacagtgttcttatttaattgtggcaatatattttctattatattctcttttcctagtggttgaaatgcatcaaaaaattcaaatttaatattcttagacgaaaactctttattaatatgtgagcgtcttatatcagctgatataagactaattatataattagttaccataaaactcttccgttaaaataaactttatgctaagatagcataaaaatatgttatttacaagtatgctatattttaaagttcttccttatttctatgattatggaaaagttttaataattacttgaataacaaatagagttaattcatattgaaggaaattataatggttaattatgtcattagtttaaaagattctgaaaaaagaagacagcatattatttctgaatttaaaatacataatatagattttgcattctttgatgcattatacccatctgagatacttaatgagcatatcaataactatcttcctaatttaaaagaaagttcgcttactgaagtagaaaaagcctgttttatgagccattatatgcttttattaaaaggtattaatgaaaattatgattattttactatatttgaagatgatattatcttaggtgaaaatagtaataaatatttaaataattatgactggtttgagcatttagatgtaagaaaagaatttattataaaattagaatcatttcctaaaaaagtaattaaaggaacgccccgctattctgtattagatagagagattttcaagttaaacagatcgtatgtaggagctgctggatatataatctctaagagagctgcagttaaagcagttgagttaatcaagcaattaccaccaaattcattagacgctattgatgaactcttatttaatcattttatcttaaataaagaactaactgtttttcaattaaatcctgccttgtgcattcaagaaagattttataataatgaagtatcagccttaccaagttatcttgaaactgatagagcaattcgtcttaagaaaattggtgagtatagaaagaaaaaaaatatactaaatagtatagctaaagaatttagaagatttgttgaaaaaattcgtagaagaactgttgaatttaaatagtgaaaaatattacatatgtatttgacatagaaaatgattatttttatgtatatttgtataacattgtatgttgaaatataaataaatggacctccaatcccttaaactttttttagacatcactcaaacccgtagttttattcgcactgcggaaaaaaactatatgagtgcttctaccctttctcgccatattcaacgtatggaacaagagattgggcagccgttgtttttaagggataatcggcaagtgattttgacggaagcaggggaacgtttttcacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtgtacttgttgctcaaactgcgggtggtttagcagaatttctaaaaggctatgacaaagagccatctatcgtgttaggttatgatggacgtaaaaattcagatgtgtttgcacgtgatactgcagaaattatggcagcagcaggcattaaaacttatcttcttccaagaaaattaccgaccccagtgcttgcctatgcaatcaagtactttgataccacagcaggtgtaatggtcacagcaagccataacccacctgaagataatggctataaagtttatttaggtaaagcaaacggcggtggtcaaatcgtatcgccagcagaccaagaaattgcagcttgtattgataaagtagcacaaggcagcatcaaagacttaccacgcagtcaaaattacaccgtattagatgatgaaattgttgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaaattgttgatgcctatattgcaaaaacagcaagccttgctaaagagccacaagttgatattaactatgtttataccgcaatgcacggcgtaggttatgaagtattaagcaaaacattagccaaagcaggtttaccgcaaccatctatcgttgctgaacaagtatggccagacggtacattcccaacggtgaacttcccgaacccggaagagaaaggtgcattagatttagcgattaaagtagctaaagagagaaatgcggaatttattattgcgaacgacccagatgcagaccgtttggcagtggcagtactagatgcacaaggtaactggaaacctttacacggcaacgttatcggttgtttcttaggttggtatttagcaaaacaatatcacgcacaaggcaaaaaaggtattttagcttgttcacttgtttcttccccagcacttgcagaaattgcgaagaaatatggctttgagtcagaagaaacattaacgggcttcaaatatatcggtaaagtaaacggcttattattcggttttgaagaagcattaggctacttagttgatccagataaagtgcgtgataaagacggtatctctgcagcgattatgttcttagatcttgtgcgtagcttgaaaaaagagggcaaaaccttagcagattatgcagatgactttactagagagtttggggcttatgtaagcggtcagatctctatccgtgttgatgatttatcagcaatcggtaagttaatgactgcattacgcaccaatccaccaagcgaagtgggtggtttcaaagtagcgactttcttagatcatgcgaaaacagatcgccaaagcgacattttagtctttgtgcttgaaaatggcagtcgcttaatcgctcgtccatcaggtacagaaccgaaaatcaagttctacttagatgctcgtggaactgatccgaaaaatgcagaagaagtattagcacagtttgatgcaagcgtgcgtgcaattcttcgtcaagagcagtatggtaaacaagattgctagttgattaaaatgttaaagccagatagatagtaaaaagtgttggttttagtttttctattaccgacactttttatatttccgtttaatattcattaatcacctatcaaatgtaatttttattaagaaaatgatgaacaataaattcaatcctaacccccctagttttaagtcagtaaaagcatgccaacctcttaaatttaaaacgaaaaaatcttcactacaacaagattatgttcaaacatcaaaaaatgagcactacaaagacaaaccaagtttatcgatttatacaactgaagctaacaaatctagtaaagagggctttgtaaaagtcagtgtaaaagacagaaacaaagctataaaaagtaaaagtggtgccctatctccaagagcaccagaaaaaatccgtaataatcgagccagtgaaatgaaagtttatggagaacatgcttgttctgctatttttcaacaacgccctgaagctatcgttcgtttatggattacctctgagtgtgccaaaaaaacaggagcgttattaagctatcttgcagatcataaaaaggcatatcatttagtagatactgaagaaatgctgagagttacaggaacagagcatcacggtggcatgtgtttattagtaaaaaaatctacaccattctcgttagaaggctatttacaactggaacgacaacatgattgcttaatactattagatggtgtaaataatgctcaaaatatagggggaattatacgtacttgtgccttttatggaataaaaggcattattgtagaaaataatgacatactgaattcaagtaatgctgctcgtgttgctgaaggcggtctagaatttgtgtatcccttagagacaaaacataaagacattgccttaatgcagttacgtaaggctggttatcaaattgtgcatttaactcgccaaaggcaagcgccacatttatctagaatagtattatctaaaaagattgtatttgttttaagtgaagttatatcaaatgaagttgaatatcctgaagatagtattgttcagctctcatttgctaattctctcaatagtgggctgaatgtggctgtaaatgcagggattttattagcgcaatggtatcaaaatcatatgttatagcgactaaatgattttactctaaagatagtcagagatgattatttatacttatgttgagtctaagcattaattatgtctatttgttcacataaaccttgcacttttctgatcggaacagaccgcttttttgcattctttttttgatacgacggagccattgaggtaaaatcctgccttattttgtaacgaaaagataacgataatgacaacgcaactttccttagagcaaattttaactctcgtcaaagcagatatgcaggcagtcgatcaggctattcttgctcaaattaattcagaggttgttctgattaatcaacttggacattacattattagcggtggcggtaagcgtattcgcccgttgattgcagtattggctgcaaatgcggttggctataaaggtcaagagcatattacctgtgcggcttttgttgagtttattcatacggcaaccttactacacgatgatgtggttgatgagtcggatatgcgtcgtggacgtgaaacggcaaatgcccgttttggtaatgcggcaagtgtgcttgtgggtgattttatttatacccgtgcgttccaaatgatggcgagtttgcgttctcttgatgtgttacaagtgatgtctgatgcaacaaacgtgattgccgaaggtgaagttcagcagttgatgaatgtcaatgatcctgaaaccaccgaagcgaattatatgcaggtaatttacagtaaaaccgctcgcctgtttgaagcggcaagtcaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggattgtatcaggtgcagaccaagcgactgtgattgcaatgcgtgattatggtcgctatctcggtacggcgttccaactggttgatgatattttagattacagtgcgaatgctgaacaattaggcaaaaatatcggcgatgatttagccgaaggtaaaccaaccttaccattgctacacgcaatgcgaagcggtaatcggcaacaagcagcattaatccgtgaagcgattgaacagggcggaaaacgtgaagccctagacgagattttggcgattatggcagagcataaatccttagattacacaatggaacgtgccaaacaggaagcacagaaagccgttgatgcaattgctattttgccggaaagcgaatataaacaagcgttgatttcattggcgtatttgtcggtggatcgtagttattaagtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatatattgtgataagaaaatataaatgacagaacaccaaccccaagaacacaaagaagcgttacaacaaaaacgcaaattaacccgtaaaggcaaagatccgaataccccttttgtgcgtgaaaaattagaactgccaaacggacacaacaaacttttactacactcttgctgtgcgccttgttcaggggaagtgatggaagctattcacgcttcagggatcgaatttgcgatctacttctacaatccaaacattcacccactcaaagaatacttgcttcgtaaagaagagaatattcgctttgcagaaaaacacggcattccgtttattgatgtcgatgacgattatgaaaacgaccgtaaagagtggttcaagaaagcagaaggtatggagtgggagccagagcgtggcattcgttgcacaatgtgctttgatatgcgttttgagaaaaccgccaaatatgcccacgaaaacggctatcctgtttttaccagctgtttagggatttctcgttggaaagatatgaaccaaatcaacggttgcggacaccgtgcggcagcggcttatgatgatgtggtttattgggattacaactggcgtaaaggtggcggttcacaacgtatgatcgaaatcagcaaacgtgaacgtttttaccaacaagagtattgcggttgcgtttattcattgcgtgacacgaataaatggcgtttagaaacagggcgacaacgtattgaaatcggcaaattgtattattcacccgattaaaaaatctccccctgcccctctttttcaaagagggggaaatttgcaagcggttaattttcaacaaatttttacaaatttaaaagaggaacaaacaatgtctaaatttgcaatggtatttccgggacaaggttcacaagcggttggtatgcttgctgatcttgcacctgtttaccctgtggtagaacaaactttcaaacaagcaagcgatgtgcttggttatgatttatgggatttagtccaaaacggcacggcagaagatttgggtaaaactgaacgcacccagcctgcattattggcggcttctgttgcgctataccgtatttggcaagaaaaattccctgagcaaaaacctgcggtaatggcagggcacagcttgggcgaatattcagcattagtttgtgctggcgtgttggacttccaagatgcaatcaaattagtcgaattgcgtggtcaagcaatgcaaagtgctgtgccagctggtactggggcgatgtttgcgattatcggcttagataatgaagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcatcaaagcgtgtgaacaagcggcaagtgaaatcggcgaagtggtttcagcggtaaactttaactcaccaggtcaagtggtgattgcaggcacaaaagcagcggcagagcgtgcaggcgaattatgtaaagaagcaggcgcaaaacgtgcattaccgttagcggtgagcgtgccttcacactgtgcgttaatgaaacctgcggcagaaaaattagcggcggcattgcaaaatatttcgttaaacgcaccgcttgttccagtaattaacaacgtggacgtagccgttgaaactgatgcagataaaattcgtgatgcgttagttcgccagctttatagccctgttcgttggacagaaactgtcgaaaaaatggcacaagatggtgtaacaacactgtatgaaatcggcccaaataaagtactgaccggcttggcaggtcgtattgttaaagaattatcggcaaaagcggtaaatgatgtggtatcgtttgaggcggtggtgttttaattaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctggatattttcccgtaccatttaaaatccccccctagccccccctttttcaaagggggaaatggttaaattcaattaggaaaaatatacatgcaaaacaaaatcgcattagtcacgggagcaactcgtggaattgggcgtgcaatcgctgaagaattagtgtctaaaggtgcattcgtgattggcacggcaacctcagaaaaaggggcagaggcaatctcagcttccttaggtgacaaaggcaaaggcttagtgttaaacgtggctgaccttacctcaattgagcaagtgcttgctcaaatcaaagaacagtttggcgacattgatattctcgtgaataacgcagggatcactcgtgacggtttattgatgcgtatgaaagaagatgactggttcgacattattcaaaccaacttaacatcaatctaccgtttatctaaagcggtattacgtccgatgatgaaaaaaggcggccgtattatctctatcggttcggtggtaggttcagtgggtaacccagggcaaaccaactactgtgcggcgaaagcgggtcttgttggcttctctaaatcactggctagagaggtggcttctcgtggcgtaacggtaaacgtggttgccccaggttttatcgcaacggatatgacagacgaacttaccgaagatcaaaaaaatgcgatcttaagccaaatcccagcaggcaaacttggttcagcacaagatattgcaaaagcggtggcatttttagcttctgatgatgcagcatatatcaacggtgaaaccattcatgtgaatggcggtttatatatgaattaattatttcaaaaaataaataaaagctgaattttgtaataggcaaaattcagctttatttttatctattattgtggataataaatcctctttcaaaaataaactagagaaatacattatggttaaaaatatctttgtcatcggctttatgctgtttgcaattttcttcggggcaggtaacttaattttcccgccgaaattgggtttcgatagcggagcagatttctggactgcaattttaggctttaccttaacaggtgttggcttacctttaatcgcaactatcgttgcagcttgctacgaaggtggttataaaaaagcccttgaaaatatccacccagcgatttcgttgcttttcttagcggcaatctatttgacaatcggtccattcttcgcaattccgcgtacgggagcgaccgcttatgatatggcaattgtgccgtttgtaggtcagcctgattctacatcgctatttattttcacagctatctattttggtttagcactttggttaagtctaaatccaagcaaaatgatcgaccgcattggttcaattttaaccccagcattattaattctaattattgccttagtgatcaaagcgatagctctattctcaggcgttgaaacagcagaagctaaaaccttagaatcacctttaagaagcggtatcttagaaggctatcaaacaatggacgcattagcagcctttgctttctctgtgttagtgatcaatggtattaaagcaaaaaatgcaaatagcaacgtatctttagttaaacaaacgacttacgcttcttttgtcgctgcaatttcattagccgttatctatatttctatcggctggatcggttataaaattccattaagtgcagaaacagtggcagacgttgctgctaaagggcaaaacttaggggtatttattttaaatgaaaccacaacccaagcctttggtgaattaggtcgtaccgtattaggtttcatcgtaactcttgcgtgtttaaccacagcgattggcttgattgtatcaacatcagcttacttcaatagcattttcccgaaaatttcataccaagtttatgcggtgattttcacgttaatcggcttcggtttagcaaaccaaggtttaaatgaggtaattagcaagtctgtacctgtattactcgtgttatacccgatttcaatgactgcattgttggtattattagtgaacttattcttcccattaccacgtttagcacaaggtttatcgattgtatttgtaacggtcatttcaatcttatctgtggcaggcgttgaatttattgctcaacttccacttaaagcctactcaatggagtggttgccatttgcacttgttggctgtgtgattggttatgtggttggtaaagtgaaaaaagattaattcatcttattttgttgtataggggcgttttcgccccttttttataaggaaaaacaatgccagaattacccgaagtcgaaacaagtatgagaggcatctcgccttaccttgtagggcagaagatcaaagagattattgttcgtcagccgaaattacgttgggctgtgagttcagagctttcaactatgcaaggggcgacgataattaagatttaccgccgagctaagtatttaattattcagacagataagggcgatattttagttcatttaggaatgtcgggatcgttgggtattttatcggtcaaagagaataaggcgatagataagcacgatcatatcgatctcatcacagaaaacggcgtaatcttacgttataacgacccacggaaatttggaacctggctttgggcagagcaagctgaaacagcagagttattagcaaatttagggccagagcctctttcagaagcctttacaagcggttatttatttgaaaaaagtcgcaataaaacggttgctgtgaaaaacttcattatgaataacgctatcgtcgttggcgtgggcaacatctatgcttgcgaatcactttttatggctggaatccaccccgaattagccacacaaaatctaaccgcgaaacagtgtgagagattagtcactgtgattaaagaggttttgacaaaagcgattatccaaggaggaacgactttgaaagactttattcaacccgatggaaaacctggatatttcgcccaagtattacaagtctatggtcgcaaaggcgaggaatgtaacgattgtggctctattattgaagctaaggtaatcgggcaacgaaatagtttctattgtccaaagtgtcagagattaccgaagtaaatgacatagtagacaaatgtgttaatgttttacaaactatgcgtttaatcggtattatatagcacttgctacataacactgctttttatatggcatagcaaccattttgtctactattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgctgaatagggttcaatctatgaaaaagctccttattacattattggtggcagcgattgccacctttgcattcgctcaaaccttcacttgtagcaaacgcacctgtagccaaatggacagctgcgaagaagctcgttttcacctcactcaatgcggtgtcagtagtctcgaccgtgataaagacggcataccttgtgagagtttgtgtggagggaagaagaaatgattagagatgtttatgagtccgctaaaacaatcaaaaatgcattagaaactgttggtaaattaaaagacgatatcgaacatttaaaagcaataggtgaaaccagtgccaaaacactggaagtcacccaaattgctattcaattacaaggtttggttctctctttgcaaagcgacttgctgacgttgcaaagctctaaagctgatttggaagcagagatcagccaacttcgcaaatttaaagtagagaaagaccagtattcgccatttcaattttccacgggggcattcgtttatcgctccaatcagtgctttaccaatgcgaacggggagattgtgtttcattatctttgtgcaaattgcttcaatcagggtaagaaatcgatccttcaaccaagccctatagaaggttattttgaaatgctctcttgtcatcattgcctcgctaaaattcaatataagagaatagaaatggaatgtgcggttgtcagacatcgcagtagccgttggtctgatggttattaaaataacggttattcatacaaaagtttcttaaactagtttaaaatccatttaaccctcttttttatacactccgttgtgaagttaaacctttacaacggagttttttatgtcccaaactgcaaccctttctgattttaacaaagcctttgatcgtgttattcaacacgaaggtggctatgtaaatgacccacgagatgcaggcggtgaaaccaaattcggtatcactattcacactgctcgtgcaaatggctatacagggtcaatgttcacaatgactcgtgatgatgccaaacaaatctatttaaaagccttttggcaacgctatcgttgcaatgaatttcctcctgagcttgcttttcagttttttgatgcctgtgtcaatcacggttcgggtaatgcaagccgtatgctacaacgtgctgtgggtgtcgttgatgatggcattattggtgagattacccttgcggcaattcgtaagcgttccaccgtagaagtcgttacccttttcaatgcagaacgccttgagttttataccaagctcagtggtttccaacattttggcaagggctggattcgccgtatggcaggcaatctgcgttatatcgctgatgatgtgggagatgaataatgaaaaaactcagcaacaacgctaaacgcagtcgtgcaaaaaatggcggtcgttacactaccgctgaagtgattttattagaacgtgggtggtattggtaatggctaaatttgcagaactctttactaattcagacggtcgcctttcgaccacgggatttatccagtttttcggggcgttattgatgtcagcgattttggcttattgcgtctatttagatcgcagttatgtgcctgaattatttatgacctttgcggtgttctgcggtggtcaagtggctacaaaaggttttgctaatgccttgagtagcaagcgacaaggagagtttgaatgatgacagtaaaaattgtgaccgtagtgttatttcttgctgcttgtgttttgttttggctttggctcaaagcagaacgcttggcagagcgtaatcggaagctacaagcagaaaaccaacaacaagcggtcgaaattcagcaaaaaaatgcagaggtacaaaatgcaaaaattcaacaaacgcatcgtgaaaatgttcagcgtgttagccctgataccgttgatgagcagttgcacgcacacaactacttccgtgacgacgacaggttgcacggcattcgggctgatttacccaagccgtcaggatacgacggaaacgaaacgccaagtactagcacacaatctgacctatgaagaagtctgtaaggagcagtctaaatgacagagattctggatttcttacgccaacatttcgccttgatttctactgttattggtttagttggggctggattttggctaaaaatggatagtaagtatgccaaaaaatccgatgtgaatacccttgctgaaaatgttgaacactatgaccgtcgtctaactcagcttgaaacaaaagtggataacttacccaccgctcaagatgtggcaagacttgaaattttaatgacggaagtgcgaggggaaacgcaaacggctaatgcaaaaatgacttcaataaatcaccaagttggcttattacttgaagctaaagtattaaaggaatgatgtatgcagacaattttaactaaagatcaacgcttagtgattttacgttctcttgccgaggctggctatgatgccaatgagtctattttaagtgattgccttgatttatatggtcacgatattagccgtgatcttgtgcgtaatcaccttgtatggctagaagaacaagggcttattcagcttgagcgtttaaaagatggctatatggttgccagcattacgcaacgtgggttagatgtcgctcaaggtcgagtgacggttgaaggggtaaaacgcccaagacctaaggtttaaacggtttttaaaggatatttaaggagcgtttaaatgaatgagaaaacgacccgtgggcgtgcgagtaaagttgatttattaccgccgaacatcaaaagccaactggcaatgatgctgcgtgacaagcaatattcacaaacgcaaattctagaagaaattaacgatctgattcgtgattgtgggcttgatgaaagctattgtttaagtaaaacagggctaaatcgctatgccaaccgtatggaaaaaatggcaagtaaaatccgtaatgcacgagaagtggcagagatttggacgaaacaatttggtgaagctccgcagtctgacattgggaaaatcgtgatggaaatggtgaagaatattgcctttgaaacgtccattagattgggtgaacaagaaggtggtattgagccgaaagatttagcattgttatcgtcagcattacaacgtttggaacaggcggaaagtttaagctatgagcgtgaacgtaaaatccgcaaggaagtgattgaacaagcagctaaagccgtagaagaaagtggtacacaggcaggactatcccttgaagatgtgacaaaaatggtaaaagcagtttatggcattgaataacaccgttctctatgactatcaaaagcgatggttaaacgataaaagccgtttcaaagtagcaatgtttgctcgtcaaacaggtaaaacatttaccactacccttgaaattgtactggattgcttagaagcagaagccaacggcgaacgtactcgctgggtgatcctttctcgtggagaacgccaagcgaaagaagcgatgaatgaaggggtaaaacgccatcttgaagcaatggggattgtttgcgaagtattagaagtgccttttaaagaagacactacgattaatgccctagaagtgatcttccctaacggttcaaaaatcactgcattaccagccaatcctgacacggctcgtggtttctcagcaaatgtgttcttagatgagtttggattccaccaagatagccgtgaaatttggaaagccctattccctgtaatttctgctggttggaaattgcgagttgtttctaccccaaatggtaaaggtaacaagttctacgaattgatgactgacttaaataatagtgaatggtcacgccactcggttgatatttatcaggctgttgcagatggcttaccacgtaatgtagaacagttaagagtgggcttaaatgatgaagatgcgtgggctcaagagtttgagttgaaatggttagatgaagcaagtagttggctttcttatgatttgattgatggtgttgagcattcacacgcaggattaccattccactatacaggtaacccgtgttttgtcggcgttgatattggggtgcgaaatgacctatttattatttgggttattgaactagtaggtgatgtattctggacaagagaaatcaccgctttaaaacgagcgagttttgcaacacaagatgctgagcttgaccgagtatttgtagaataccgtgtattgcgttgttgtattgaccaaacaggcttaggggagaaacccgtagaagatgctaaacgccgtttcggtgaataccgagttgaaggggttattttcacccaaacgaataaaatgatgcttgctacccttggaaaagaagtatttgaagataaacgactacgcattccgcagggagataaagtattacgagaagatttgcataagctcaaaaaggtgactggagctaatggtcagccacgctttgttgcagaacgagatagtcaaggtcacgcagatagaacttgggcttgtttcttagcgttgtatgcggcatctgatgtgaagcaacctgttgcaccactagcacgcaaaccacgtcgtagccagcaactttctgaaggttattaggatatgaaaaataaaaaagacttaatcagcgaaattgccactcgtgcaagaagttttgaccattgggcaacggggtatcatctgccgaaccctgatcctattctcaaaaaaatggggaaagacattgctgtttatcgtgaattactatcggatgggcaagttcgttcaggtgtccgtcgcagaaaggcggcaattaaaggcttagagtggcgaattacgaccacgaataatgaaaaagttgatgagcaactttatcaagtatttaaccgcttgccattaaataacatcatcaccgaaatgctaaacgcttcgctgtttggttatcaagtttctgaagtgatttgggcggagcgtgatggtttgattgtgccagctgaaattatcggtaaaaagcccgaatggtttgtgtttgatgaagacaatcagcttcgctttcgtaccaaggagcattggattgatggggagttactgcctgagcataaattccttttaactacgcaagaagcgacccaagacaacccatacggcttaggcgatttatcgctgtgcttttgggcggcaacctttaagaaaggcggttttaaatattggttagagtttaccgaaaaatacggctcgccgtggcttatcggtaaacaccctcgcacgacatcagagcctgaaaaagatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgaaaaagatcgtttggctgatagcctagaagcaatgataggaacagccattgcagttatccctgatgatgccagcgtggacattgtggagtccgcaggtaaaggggcttctagcgacagttacgagaagttcttagcgttctgtaaaggtgaaatcaatattgcgttattggggcaaaaccaaacgacagagcaagaaagtaatcgtgcatcggctaccgcagggcttgaagtgattgaagatattcgtaacgatgacaaggcaatgcttgaagccactttcaacaccttgttgcaatggatttgtcactataacttcaatgtcgagcagttgcctacatttgagttttttgagcaagaaagcataaataccgagcaagttgagcgtgatgagaagctacaccgaatgggtgtgcggtttacgaagcaatactttatgcgtgaatatggctttgaagatggtgatattgagctacaagcggtgagttcgacggtaaattttgcagaacatcaccatcacgaaacagaaatggatcggattgtcagccaaatgggtgaactttctcagtattcattaaacgctaatattgctcaagttagagcaagacttgataccgccgagagcctagaagaagctcaacaaattttagatgatattttgccccagttagattttagtgaatatgcacaactgtttgccgaagggctaaccacggcgacattgcgtggtcgctatgaagtgaaacaggaagccaagcgatgagcattgttgcacaacccttgccatttagtgagcaaattgaatacttccgtaagaaagtaaatatcccaacagcaacctaccttgatatttacggcgaagcccacgactatgcttttgtggttgctggagctcatacacaagaaatcatcggcgattttcgccgtgcgatagatgatgtgattgatcgtggtggcacattagaagagtttcgtaaggtattcgatgccattgccgacaaacatagctgggaatataacggcgggcgaaattggcgtagccgtattatttatgacactaatctttacgccagctataaccacgggcgttatatgcaacagcgtgaacttgctgatgtaatgccttattgggaatatgagcataatgactcagctcacccaagaccgcaacacgttgcgtgggacggcttagtattacgagcagatgatccgtggtgggactatcattatccaacccgtgcatacggttgccattgtactgtgcgagctttagatgatgtcgatctcaaatatcaaaataaaaccgtgcaacaagcccctgaaattgagtgggaagaaaaggttatcggacagcgttcaggcagtccgagaattgtgcgagtgccgaaaggtgtcgatccaagttttgaacacccaaaacgccttgtgcctgtgcataaggtagatgaaattttaatgcagaaactggttgaggctccaccgcagtttgccagttctgcggtgagtaatgtcttgaattatgccccagcgttagccttattaaaccgttcaatgaaagagatggtggatacggttgtcgcagataaaatggctcgtgggcagatgaaatatgttggcgttattccccgtgatgtagtgaaaaaactagaaacgatggagcttgctccacagaccgccgtgattgcagtgcgtgatgacgatattctgcacgccttgcgtgatgtgaagcaaagtaaagggataaacctaccgcttgagttttggcaacagttgcctgaaaaattgcgtagtccgaaagcgattttattagatagttctcaaaaacttaatgcactgttatttgtgtatgacgaagatggagccaaaataatcatttcaatggactataaagtacaggtgaaaaacagtgttacgaagaaaaaggaacggattgcactgaatatggtgacaactggcacaaaaattagcaatgctcgtcaatgggaaagtttgaaaggctatgaagtcttatggggcaatttagaataatccgcaggtttgcctgattcgaacaggatcatacggtagttgcctagcgtaacctttccagtaggaaaccccctgcggataaccaaactatacgcctaaactattttttaatcaataggaacaataatgatccatattaaactcgatgctgaccaagctctcagaggcttacaccgtacagcccaaaacttgcaacagggtaaaaagctctttggggtattaggtgaaacgttacgttcaattcacaaagaccgttttgagaaagaacaggcttcacctgatggagaaaagtggacaccattatcggcaaaatatcaggctaaaaaacgaaagaatgccgataaaattttaattcacgatggctatttgagaaatttactccgctttcaagcgactaatgaaggcgtaacctttggaagtgatcgcaagtatgctcgcttacatcactttggcagtaataaagccagtggcaaaggttcaggtattcctgctcgcccttggcttggcgtaagtaagaaaaatgaaggctacttgctggcaaaaactgaacattttttacgaaatgtgattggtcatagctaaatttcaaaaataacgcctaaaacgcccgatttagcgttttattcttttttcaataaatgatagctcgatacaaatttaaggcgtttataaacacctgtaaacgccttaaatcgcatattacacttctcttacttgtctattttatttttgcattccttaaactagtttaaaagccgaaaacacgctcttttttcataatgcttatcgaaacggaggcattatgaatctaatcgaaattttcaaagctggcactcgtaaagatgccaatggcacagaagtcactattactgttgccgacctaaaacaagccgtagaaagctataacgtggaatttcacgaagcccctgcggtgattggtcaccctgaacataaccgccctgcgtatgcgtgggtaaaacgtctagaactggaaggcgatattctcaaagcggaacttgaccaaatcgatcctgaatttgccgagatggtggataaagggcggtttaagaaagtgtctgcttcattctatctcgccaatagtccgaataatcctaaacaaggctcgctctatttacgccacgttggttttttaggggcgatgccacctgcagtaaaaggacttcgtaaccctgattttgccgaaggcgaagaaggtgtagtggatttttcagactggacggaagcatctctatggcgacgtttgcgtgattggattattggcaagcacggtcaggaagaagccgataaagccctgcctgattatttggtatccagcattcaagaagatgctgtgcgtgaagatatgaaacgcttttatcaagtccctgagtctaaccctatttttaatgaaccaaagaaacctgaaggagaacgtcaaatgtcaatgacacccgaagaaattgcagcaatgcaagacgaaaatgcccagctaaaagctgaaaaagctcaagctgaagcagataaagttgccgaaaaactggaagcaaccaaggcggacaatgcgtccttttgtgaaaacttagtcactcaaggcaaacttgcccctgttgcaaaagacgctgctcttgccttgcttaactgttcggcaacgatggcaagcggtcaagtcgtgaattttaacgaaggggaatctattcacagcttaaccaaaaagttcttagaaacccaaccgcaagtggtgcagtttggtgaagtggcgacgaaagagaaagcttatgaaggtgagcctgataccgtcagttatgctgaaggaactgatccaaattccattgaagcagaccagaaaattcgtgcttacgccaaagaaaaaggggtgagttacaccgaagcatttaacgctatttacaaataaggagccgaaatgactactcataatttacaaaaactccgtgtgcaagaccctgttttaacagaactcgcacaaggctatcacaacaacgaacttgttggcgaaaccttaatgccaacagtagagatcgaaaaagaagcaggaaaaattcccaaatttggtcgccttgctttccgtttacctaccaccgtgcgtagtttgcgtggcacatctaaccgcttagatcctgaagatattacagcgattgatgtttcactcgaagaacacgatgtggaatatgccattgactatcgtgaagaaaatgaagcgattttctctctccgtcaatttgccttaaatacaacgcaagatgtgattgctttaggtcgtgagaaagaagtggcaacgcttgctttaaatgaaagtaaatacgataccgcaaacaaaattgcattaagtggtacatcaaaattcacccataaagatgctgatatttttggcatttttgatacaggtattcgagcgattaaacgctctattgggcgtaagccaaatgtttgtgtgattgcaggtgatgtttgggctgcacttaaagagcatccaaaagtaattgaaaaattgaaatattcacaagttgctatcgtgacacctgaagtgtttgcgaaattgattggtattgataccgtcaaaattggtgaagcagtctacgagcacgaaagccaactcaaagacatttggtctgatgcggttgttttagcttatgttgccccacgctcagcacaaggtaaaggtacggtttatgagccatcttatggctacaccgtccgccgtaacaagggtttatttgtcgatacatataaagaaaacggtggcaagattgaagtagttcgtaccaccgatattcacaaaccacatttagtaggggcttctgcaggctacttaatttcaaaatgtatctcagcctaagtgatggggaatttccccatcatactctgaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaaacaaacaatgaaagccaaagtaaaacatactgcattgttacataacggtaaacgttatgaagtaggtgatgatattgagctgaccgaacaggaagctaagggtttagcttattaccttgaattaatagatagtaaagctgaagaaaacaacgtagaaaccactaaggtggaagatacagcaaaggctgatgaagctacaaaagtacaagctgaagctaccgctattgccgatgagttagatgctaaagaagcggaagctacggaaaaagcgactaaagaaaaggcaaaaaataatgtacatcaccgctgatgagttaattggctcttttagtaagcagatcttagttcagctcagtaatgacgaccacagagcgacggacgtgaatatggctgtggtggaacaggcaattcaaacggcttgtgaacgtattgatgcgtcactgcgtagccgttatgccttaccccttactcaagtgccaacaatgattaactcgcacgccttgtaccttgctcgtcactggctttacactcgccgtgcagaaatgaaaatgcctgaaacggtgaaggacacctacgctcaagtgattaaagagctagatgccattgctaaaggtacgttacatcttggtttagccaatgcagaagatgtgagtgaaacaggcgatttattgcctgacgtgggcgaatatgcggtgcgagccaaacaacaaatagacacagggggttactaatgtctgccaccttgccgattttgaccgagtttgaaactcgcttgaaaacgcagtttcccgattgggatattcagctaatgcctgatgaccctagccactattttctgtcgcacccaaacggtgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgattagttatgctgggtcaaaatttagcgagccacgctctacgtcggtaattacgcaaactcgcaaggtgcatattgtctttacggtgttaagtcgcaacttgcataacgactttggtgctttgcagtttttagatgagttacggctttccgtagttggctttcaaccgatagactgtacgccaagctggttagttgaagaacagtttgatgagcaagatagcggtgtgtggatttaccagctggttttagccacagaaacgttgcaaattcaacggctacaagcggtcgatttagagccgaaatttaccacgtttattgctagataagagcatcagccccttgatgcccgtttaaaacccaaatcataggagaatattatgtctcaattccatcacggtacagaaaccaaacgagttaaaggcggttctgtgcctgttcataccgtcgatggtgctattatcggcatcatcggcaccgcccctgttggtgcagtgaatgagctgaaattgtgtatgaccaaaaaggattttgcacaattcggcaatgtgttagatcgtggctataccttgccaaatgccttagatattattagccgttatcaagcagggcaagtttatgtggtcaatgtgctagacccagctaaacaccgcacgacggtttcaagtgaaaatttaaccttagataaagaccgcctaaccgcaaccttagcatacgctggagtgattgaattaagtcttagtcatagttcaggctcgctgacaagtgggcaagattacaccgccgatttattgacaggtgaaatcaagtttcatcgtatgttagaaaatgtgactgcgacttatacctatgcagacccaaccaaagtcacggaagcggatattaaaggtgcgattgatacaggcacaggcaaacgtacaggctttgaaatgttgcgtgctggttttaacttgtttggtagtgatgccaagattttactctgcccacactacgacactcaagcaacaatggcaacggcactagaaaccctagcaagccaactcaatgcgattgcttacatccaagctccacaaggcacaacccttgcaaaagccttagcaggacgtggcacggaagggcaaattaacttcaagacttcaagtgaccgtacacatttattcttcccacacgttgtgggtgagcgtaatacccttgaaagccttgcgacccacgctgcaggtttgcgtatgcgaactgacgttgatttcggctattggttctcaacatctaatcgtcaattaaaaggcgtaattggggttgaaattccgctgaccgctcgtgttgatgatattcaatcagaaactaaccgcttgaatgcggtgggaattacgacggtatttaacagctatggcacaggcttccgcttgtggggtaaccgcctagctaattatccaacggaaacccatattgtcaattttgaagtggtacaacgtactgcagacttaattgatgaatctcttcgtcgtgtagagtcgcaatttattgacttgccgattgatgatgccttgctagattcattactaggtacgattgaaacctatatgggtacattacgttctattgttggttttgaagtctggcttgatcctgatgcggatttggttgatgcctttagtaaaggcaatgtgccgattaaatataagttcacgccaaaaatcccagcggaacgcatcacgaatacgtccgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcaaccgcttggggttctgtgactacattctttagtaatttatggacaacattatcaacttcagtaacccaatttattagcacaataggtcagacaatcctgaattttaatccattggcactcttccagactgcattctcaacagtgctgtcttggtttagcattgatttaccgatgcagtttagcaattttggtaaaaatattattgacgggcttgttggtggtatcagcaatgcgtggaacttagccaaagaaaaagtcagtgaattaggcagtggcattaaaggttggtttgccgaaaaattagggattcattcccctagccgtgtatttaaaggctacggtgtcaatgtagtggaaggcttagtgattggtatggataaggctcaaccccttgcgactgaagccagtcaacatctttccaatgcggtgacatttgagcctgttttaaatacggttgaaacgatgtttaaaccaactttaagcaaggaaaaaggcttctttggtagtttatgggacgatattcaattcggggcgaatatggtcggcaatctattgggcttaaatcaacctacggatttacgcacgccgtcctttaatccccaagcaaaagacggcggtttgtttgcggattatcaacccttaaacagaaatgaagtctccaatacagcaacaacccataatcaagggattacggtgcattttagccctaatatcacgatctcaggttcagcccctgcccctgatttaaaagaacagttattgcaagcgttaaatgaccctgcaatgttatacggtttggagcaactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaatcgagtaaacgaccaatttggacggagagcttactaatggcaaattacgcattacttggcaatattgcctttgatttattaactgccccttcagcctttgatgaacgtcgttcggcaacctttgcagaacacgctgtgttatcaggtaagccgaaactgcaggcaatgggcgataatcttaccgatattaccttgcaactgaagttacatcatcagcttgcccctgtagaacaacgctatcaagcgttagttactgcaaaagagaaacaggaagccctagcccttgtgttaggtttttcacggtttaaagggcattttgtgattacagatttgagtagctctgttctattcagtgatgccaaaggcaatgcccttgcccgtgaagtgtctgtgagcttgcgtgaatttgttggcaataccagtcagggcttgttgggttctgcgttgtcgattggtggattatctccccttgcttcaattttgccgaaagacctaacccaatttgtcagtaaaacggctcagttagtcaataaaggggtgcaagtgtatcgccaagcacggcagacgattgatgatgtcctcaatacggtagccgttgtgcgtgctttggctcataaccctttagaatccttaacacaactgccgattttattgggtagcttaggttcatctactcaaggtttggctgagatggtggggcttggtcatagctttggcattcttacacaagggataacaggggctatgccgtttttaaatggtttggtggaactgagtgagaccttgcgtaccgctcaaactgaatttagtcgtggtttggggcagaataatttgggtgcgtggtttgatctgggtgtgaaggcaattgatgaagccgatgaaattgctcaatcaatggcaaaacctgcagcacatctaaccgcttggattgctttacgcagtgatacgccacagctgaaggagaatgttgatgagtagcgtaattgaacatcaaattaaggcaggcgaacgttgggatttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttatcgctattacggtgatatgggtgaaataagccgtttaatcgatgctaatccccatattccgttttgtgaagtgttaccgatgggacagacgttatttgtgcctgtgattgcggttaaagccacgtcgcaggcagatcttccgccttggatgcaggagtaagcaatgcaagtacaaacgcccacctttgagctgttttacggcaaaacggtcattacacataacatcaagccccatttgattagtctaacttatacggattatttaagtgaccaatctgatgagctacaagtcacctttgaagatattgaacagaaatggattggctcttggtttccgacccaaggcgatgaactgaaactgcatttagggtatttgggcgagtcgttagtcaatttaggttcgttcgagttagacgaaattgattggtcaaaagtcaaaggcagtggttcggtggtgactctacgagccttagcgacagggattagtaaatccaaccgtacgttaaagcctaaagcctatgagaacaccacccttgcagaaatcgtgcaaaaagtggcaaaaaacttgaaacttgatgttacaggaacagtcgccaatatcccaataaaacgggttacgcagtatcaagaacgagatgtagagtttttaactcgacttgcccacgaataccatcacagttttaagattgtgggtaaaaccttagtgttcaccacaatggagagccttgaaaatcgtccacctgtgacggtattggatttttcacaagtgctgtcgctacggcttcgagatcgtattaaagatgcggtgcagaaggttgaagcggtaggactgaatgccgatagtaaaaaaacggtgaaatccgaaaaaagcagtaagcctaaacgccctacgaaaaagcaatctaaagccagtaatgctgacaccttgaaaattgtgactcgtggcgaaagccaagagcagataaaagctcgtgcagatgctgctcttgctgaacagaatgatgaccaacaagcaggcaatattcaggtgattggcaatcctaagttagtcgcaggtaatacagtgttattgacaggctttggaatgtttagtggcaaatacttaattaaatccgctcgtcatagctacactaaaaatcagggctatgtaaccgatcttgatgttcgaatgttggaatttattgaagatttaccgaccgcaagcggtctgatttaataggaattttgtaaatgaagaaagctgtcgttacccataactttggggcaacctatcaagaaggttttgtcagtcaagtcgatccgaaaaatcaccgtgtcaaagtcaaaattccaacgctagaagattttgaaacagcgtggttgccattttttaccatcaatgcaggcggtaatcagttttacggtttgcccgacgtgggcgaattggtggcaatgattttagatgcaaggggtgaaggtgggtatgtgcttggggcgatttataatagtgaagatccaacacctgttacagatagtgaaatctggttacataaattcaaaaatggcacggaaatttctcacgaccgaagctctggcaatgtgattgttaaaaccagcggtacagtcaccgtcaccgctgctcaggcagtggtgaatgccccgactgaaatcaacggtgatacggttgttaatggcagtttacacgccacgggtgcaattacctctgcgaccgaagtttctgcaccaagtgtaaaacaaggcactgtttcgctcggttctcatgtgcatactggggtggaaagtggtaataaaacatcaggtacccctaaagcctagtcaatctttaaagtagtttaaaagcccatcttcatcatagccgttacactcacggctatgaatacacatacacttcaacatacacattggcaaattgcccctgaaggcgttgagagcattcagggggaagatgatttacaccagtgcattattaacatcctttctactcgtaaagggagcgatgtattacgccctgattttggctcaaatcattttgaatatattgatcagcccttcgatattgccgtgccaaatatggttcgggaaatttttgtggcgattgataaatgggaaaaacgagtggtagtacaagaagtgcaaattagtggtgaagcaccgcattttttctttaatgtgaaatggtgcgttgctgaagatattgaacgtcaaatttatgcaacggagtttgattatggaaataaatagtcgttatgacattaccgttgtgcctgaagatgttaaacagattcttgccgagactatcgcaaaatatgaacaagatacaggcaaggtattacaacctgctcatattgaacgcttgattatcaacgtttatgcctttcgtgaaatgttggtgcgtaaagggattaacgaagcatttcgtcaaacctttccgcaaacggcaacggggattgcgttggatttgtgtggtgaaacattaggttgttatcgcttaaaagacaaagcggctcgttgtgttctgcgatttagcgtacaaggtgagcactcatctattttaattcctaaagggactcaagttgctattactgatgttctgtattttattacgctaaatgatgatgtgattacacctttgatttcttacgttgaaattgaagcagaatgtaataaaaaagggctgattggtaatgaatgggaaattggtcgaattaaaaatctcagaacatcacttaatacgaccaccacacttgaagtcaccaatattgatagacctagtggtggtttagttgaagagaatgacgatgactaccgcaagcggattcttgcagcacctgaagcatttagttcttgtggctctattgcagcttatgactatcacgttagagccgtgtcgcaagatattgcagatgtcaatattgccactcctaagggtgggcttgttcgtatcacagtattaactaaaacaggcttacctgatacacgtttattaaacgacattaaaaaatatgttagtgcagagaaactacgcccattgtgcgataccgttgaagtaattgctccgactaaacgagattatcaaattcaagcagaattgattttacttgatggttatcgtgaagatattgtgaaaaccaaggctcgtgatgcaatgcagttatatcttgctgataaaactaaaaagctcggtatggatattgtaccgagtgccattatttcggtattgcgtgttgatggcgtatatgatgtgaatttgatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgacaaaaacagtcattgctgaaaatgaatgggcaaactgtactgcattgcgaatcgaagtaaaagaggaacgcagtaatggctaagttagtataccccgacatcattgtaaatgaccctaaatatgtagctttagcgaatttgagcaatcagttagatcatttaaaccacgccaaaattatgacaacaattgtggaattactaggtgatgaatttattccactgttggcagaaaaatggagtgtcacaggttatgacggtgaatttgttgcagaagataacgactctaagcaggctctaattcgcaatgcgattgaattacatcgtagaaaaggcacacctaaggcaattcgagatgtattacgttcgctaggttttggggaaattgaaatagatgaagggctcaaggacagaatttatgaaaattctaatgtcgtcaatataccagcagatgaacgttgggctcattatgctattcgcttaagagaacctgtcactaatgatcaagcagtaaacattcgtaaggttttgagaaattttgctcccgcaagatgtttattggcagtacttgattataaatctgtaccgatcaggtataacagtaaggctcgttataacggcaaatataaccacggttcaaattaattcaacaaaggacaaaaatagaaatggcaggcttaaacgaaatagcgaaatgggaaagagaagtctatcaaattgaggaagacgatcctgtgcttggtggtgtgaaaggagtgactaacaagccccttaagcatcttgctaatcgtaccttatatttaaaacaagtccttgaagctgcaggacaaaaactgatacctaaaaaactgacagcaaccactcgcaacaccgctgacagtacagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgcaaaagcaggtaaagctattgctcagtctgtggcacagttgcaggttaatactaataatgcactaaatcaaaaagtcaataaaacggatatcagtaacgctgtcaattcaacatctcaaactacagtggcatcgtcacaagcggtaaaaacggcttatgatttagctaatagcaaatacacagctcaagatgccagcccaacccaaaaaggcttagttcaactcgccaataacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttagatacatcgagccaatggtgctggagacaaacttttgatttgcctgagaagcaatatacatttagtgctgaggtcaaacccgaaagaactgcgttttatctccatctgtacaatgggaagagctgggttaattttcattcaagaaatttgactccaggcatatggcaaaaaatatcgattaccttcgtcagtgcgataacaaacatttcattcattaatccaggtgaaggacttatagaattacaaaatcctatgcttgtcgaaggcaatagagctatgacttgggctccagcgcccgaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcgcccgaagatttaaccgaagaagcgcttaatagtgcccgtcaaaactatgttgccaaagctggggacacaatgacaggtccattgaatattaaccacgcgagttcgtatctcagaggaaagaacaacggcgttgatgactggtttgttggacgagtcagaaataatgataacgatgttgcactggtatcctaccagtataacacaggtatacacctcaagtccgacagagttgaatcgaacaaacctatctatcgaggcaatcacctcgtgtttgacgaaggaaatttgcttcccgttcgacagattgatttgcgttctattgctaatgggcaaatatctttccaagatgctacgcctgcgcagttaccgcttggagctttcgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaatatcattgagctggccaatctcagtgattttatctatcaaaaaatcggcaacttcgaaattcgtaaataccctgatgggacgatgattcaaacctatttttatgatgtaaatgatttgaaagagtggatagaaaagcaatttacttgggctgtcgcttttgctgataaacctatggtgatacctaaagtggagcacacctatggtataaacagcgatgttggtagtgctattatgagaaaaagcaccaatgctgtttgttattataaattatatgaacacaacagtgagaatcaaggtgactgtcgagtgcaatttttaggtgttggtcgctggaaataggagaatacaatggcaattttttataaagacggtttttataacaacgaccacggcggttttgtgcctgagggcgcttgtgaaatttcggcagaaagctaccgcttgttacttgaagggcaagctcaaggcaagctaattattgccgatgatgaagggaacccgattttaagtgagccaccgccgatacctattgaagaacaacgccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccgatgccaccgctgaacgcaatatcttgtctgtcaaagccacatttgacttattcggcgaccaagaaattccgtggaccttcgccgataattcggtggcaatgattaacaaagagaagctactggttatttggcaagtgttgatggaagccaaaacgaacaatcacgctaacgccttgaagcataaagcgatggtggaacaagtagaaaacccacttgaatatgattattcgagtgggtggacgcagacttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgagcagggctggcgatttagtccgaatcagttggctgtgattttaaataaaaaggagatgttgcgataatggaaaaagagcaaaaaaaactatggcaacttttaaacaagccccattgccttttatcgggcaaaaaagaatgttcttaaagcattttagtcaaattttaaatgataatatcagtggagacggcgaaggctggacgattgtagatgtgtttggtggtagcggtttgttatctcatactgccaaacaactcaagccacgagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttaaacacggcaaactggtgctggaggcaaggtgcaatcaatgcacacaatccaagcagtatctattgcgggcaatagaaaagcacttgcgggtatctctttaggtgcaaatggaggaactgaaagttctgtgattgtgatggccgataaatttaacgttgtcaaaaatgcacgagatggcaacgttaagccaatgtttagtgttgttaataaccaagttgctgttaacggtgatttgattggagatggcacagtatcggctcgaatgatggcggctaactcaattgctgctggggctattcaggggggagcagttcgcgcaaatcatgttgcggcaggggagatttctactgaaaaactggcttcagaggcagtcactaccgagaaaattcgaagcaacacaatcacttccgataaaattggtacagggcaaattatcacaaatcacatggtggctgggtcaatagatggaaaaattcttcgtgcagggacggtaacagcagataaagtggtagctagagtctccctacaatcaccagtgattcgaggggggattttggaagttgggagccttattggtggtaacctctatgaggttaaatctttcacaccggctggtcgaaatcaaatgagcattacgatcaagccttcaatagcacaacgattactgaaaatgacttgggattatggtactgttagattttcaggtaattctgctgctattggtggtactggcgattgggtaacaagcataaaaaattcagcaggtactgtatcacagcatttaaaaggattttacacgctcgttatcccatctaatacacaggtaacgttatctttaacatttaataccacccgtataatgaatcaaattcttgtagaaacagttgtttattctgggtcaagttatatacaataggtcataccttatgacatagggggaaattatgaaaatcttgtcttcaatatcgatgattgctttaggcgtaacattgattggttgcggaagtggtggaggcggtggaggcagtagtgctagcaatccgccctctcaagttccgacaaagaccgaaccgcaattacccacaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctcaggttgaaagtgaatggaaagctaagataagggaggcgaagttaattaggatcgatcatgagacacttagactttctgacgatgtggcttttccatctcagatatttaatatggcagatgagaagcttggtaagctagaacaagaattagggcgtaattgggttctcaaagcctacaacttaccttattctgcagttggctatgtattaccagcagatgtctcaacagatgaatatggacgtgtcattgatagccgagcgaataattatatggctgaagtagttggtgcgagaacggaaatattaccaaaaggctcagcgtactatgaaggagtttcttttggtgcaaattctgagggtaaattgaagctgtccataaacttctcagacaagactatttctggttcggtgactgatagaaagctacttagcacaaaagaggcactagcagatattagcttgaaagaggcaaatatttcagctgttggagaacaccatttttcaggtgttgcggaatcccaaggaatacaaggtagctactatggctcatttttcggtccaaatgctgaagaagttggcggcatcattcgagatgatgctggcaataagtatgaaggattttctggcactaaataatttcagcctcttaacgcaaaaaaccttgatagaaaaaactatcagggtttttctttttctaaaacaaaccaaaggagtcttatatgcaaaaagatgtgaaataatggtgggtattttagatggggaatctctgtaagtctttgttttaattaaataaataaacgccttttattcgatatgtattgcccttctaaggcgtgggtcaaaggttcgaatcctttagggcgtgccatttaacaaatgaatcttttaagttcacctcctgagtttgataaaataagcaaaacccagcctatttaaaggtggctgggttttgcaagtgatgtactaattgcgaattttattgagctaaacacacaccaaattgatccgccaaagattgtaaaaattctggataggcgtttttacttaattcaatttttgcccctaacggatctaattgccctactttggctgatgtgcctttgcttaagctctcaatcacttttggcgtaaattgtggctctgcgaataaacattgtgcttttttctgagcaatgcttttcttgatggcatttaaggtttttgccccaggtgcaacggttggattgattgtgaatgaacctaatgatttcaatccataagcctcttcaaaatagccgtaagcgtcgtggaaagtgtagtaaccttttgattttacaggttctaactgttttgcaatctcgctatttttcgttgccaatgtcgctttgaaatttgctaaattctctgcaatttttgctttttgctcaggtagttgctggcttaaacgctcagcaatttgttctgcgatatgttcacttgctttaggtgataaccaaatgtgccaatcttcgtcgtgactatgtccatcgtgactgtggtcgtggtgagcgtgattgtgggaatgtttatgctcgtgtttgtgatcgtgtttatgatcgtgcttgtcttctttttcttcacctgaatgctccacaagctctttaattgcaggcacatcttcaagggttaagactttctcttttggtagtttttcaatacttttctctaaaaaagtttccatctcttccccaatccatactacgagctgtgccgattgaagttgttcaacatcagagggtttgaggctgtaatcgtgtggcgaagcactggttggtaatagcactttagtttctgtgacaccgtcggtaatcgcattagcgataaaacctagtggtttgactgtggttaaaacatcggcattggttactgcagttgcccccaataatgcaaggcttaataaactttttttaaacatagaagatctcctctcaaataaagcggtgagatcttagcagaatattgcaattaatctataatttttttatggttattagcattaatcacaaaaaaataaggacacccaaaagcgtccttataaaactgacggtaaaactacaacaacatcttcacaatcttatccaatttcacccgtccaaattttttcagtaattttttcaccttttcggggtaatcttttagctcttctaaatcgctataatgggttaagactgttgtatgtgtacgaatttgtgctaactcaccttgggtcttttcactcagctcaccctttggatcagaaatcaacacggcattttctgcatctaatttccacgcacgtgggttgagattgtttcctgtaagtagaatataacgctcatcaatccatacgccttttaagtggtagctgttcttaccatctttccacaagcggatcgttaattgcccattttggatataatgatcaaactttttcgtaaatgctcgcagatttttttcatacagatacggcaaagcggacgccatcgtaaatttttcttcaggtggcgtgaaaaagtcgtttgctgttttatcaccaacaataatttcaatctgcttgccattgtctagtaaccaagcgatacgttggctgatagaacgtgggaaattgaagtacggggtgcaaatggttaatttctgctgtacttggaaaaatagtgcttcaatcgttttattcagcggatttttacgccctaagcccactaaaggtgaaagcattagttgggaatgatccatcgttctaccgttaaaacgatattcttgttggcttaattctttacgaaacgttttaacaagcggtcggatttcaatggtttttggacgatttgcttgatccaagcgatttaccgcagggttgctcaaaatattctgctgaatgaaattgacccagctgtctgccaaagttttattttcaatttgatgataacggtcgtaacgataacgctcaaactgctgtaaatagacgttgttgatgctcgctccgctataaagcagggtatcatcaaacacaaaaccttttaggtgtaacacaccgaagatctcacgtttattgacaggaacgccataaaacgcaatctcttgctccgtcggcaaggcatattgctcacgcatctgggtgtaccagtcggcgtttgaactttgggttgcttcgccaatacgtccacgttgagccctatgccaatctacaaggattttgatttccaactgtgggttagctaatttcgcttgataaagtgcatctaagatctcttgcccagcttcatctttttcaaaatagagagcggtgagataaatgcgacattttgcttgttttattaacgctaaaatgtgttgtttaaactcagtgctactggtaagaaaatccactttttctaccgcttgggggataaaagtgagattatctaagtggcgttttgcacgggtttgtttgtttagaataagcatcttatgctccatttttctttacttcgtagatagtttctacgcagtaacactatccctacttttcttttctttgcttcgccaaagaaaagtaggcaaaagaaaggcgaccccaagcgtttcttcttcctacgcttgttgctaatttttgggacgaacttttcaaactcgcttgcttcgcaagctcaaacacgaaaagttgtcctcaaaaattgacgcaaccgcttcggcgaaacgcaggggaattgatcgaacatctcgatctcaactttgcaaaaaattaactaaaacttaccgcttgtttggcggtttgggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattaagcgatgatgaaactacgcaaagtttcttgtttcaccttccccaaccacattctccacacaacgcccacaaatttcagcgtgttctgcattcgcaccaatatctgtcgcatagtgccagcaacgtgggcatttttcaccgtctgcacgttctactttcaccgcaagaccagctaattcgccttctgcaacatcagattctgaaagtggtttaacaatcgcttgtgaagtgattaacacgaaacgtagctcgttgcctaactgttctaacagtggacgaatatcatcatttgcataaacggtcactttcgcttcgagaccagcaccaattaacttgtcgttacgcgcttgttccaagacacggtttacttccgcacgcacttttaacagtttttgccagtagttgtcatctaatttgtcgctttcacttaaaccgaataagcctgtgtagaattcttcagtaaagacaaattcagaacgcccttccacttgtggtaagtagccccaaatttcatcggcggtgaaggataaaatcggtgccatccaatgtactaatgcttcagagatatgccacaacgcagtttgacagctacggcgtgcaaggctgtctgctttggtggtgtattgacggtctttgataatatctaaatagaacgatcccatttcgattgaacagaaacgcattaaacgctgaacaacggtgtggaattgataattatcataggcttctttaatgtcgttttgcgcatctaatgcacagcttaccgcccaacgatctaatgcgatcatttcttccggtttaaccaaatcacgttttggatcgaagccatttaagttcgctaataagaagcgagcagtattacgaatacggcgataagtgtcgcctgcactgtttaaaatgttgtgcgaaacggcaatttcacctgtgtagtccgtagaagcaacccataaacgtaaaatatctgccccatttttgttccatacttcacttggcacaatcacgttaccgagtgattttgacattttgcgacctttttcatcaacggtaaaaccgtgtgtaagtacttgattataaggggctttattatcggttgcggtagaaagcatcaatgatgacataaaccaaccacggtgttggtctgaaccttcaaggtacatatccgcagaattgccattaaactctggacgttgttgtaccacagacgcataagtcgatcccgagtcgaaccatacatcaagggtatcaggtactttacgatagattttcgcatcttcttcgcctaacacatctttcggatctaaatcccaccatgcttgaatgcctgcttgttcgacacgttttgccacttcttcgagaatttctaaggtgcgtgggtgcaactgttctgtttcattatgtacaaacattgtcatcggcacgccccaagtacgctgacgagagatacaccagtcaggacggttcgccaccattgtatcaatacgcgcttcaccccaacttgggatccaacgaacacgtttaatttcgcctaatgcctgtttgcgtaaaccttgcgtttccataccgataaaccattgcggtgtcgcacggaaaataatcggggttttgtgacgccagcagtgcggatagctgtgtttgatacgctctaatttgagcaacgcccctgtttcttttagtttttcaaggactaaatcattactttcaaacacgcctttacctgcaaagaatggagtagttgaaataaatttgccatcatttgccactaatccagccatttctaatttatatttttgacccacaatatagtcgtccaaaccgtgatctggtgcggtgtgaactaaaccagtaccgccatctgtggtaacgtgatcgcctaaaataaacggcacgctaaaatcgtagaatgggtgattgaaacgcattaactctaagtcacagcctttcgctgaacctaacacttcaacttgctcaacgcccgttgctttttgtacggcttccactaattctgtcgcaagaataacacgctcatcgccaaactgtacgagctgatattctaattccgaatttaacgcaatcgcacggtttgacggcaatgtccaaggggttgtagtccaaatcacagcagaaatctgaccgcttcctttgccctgagcattaaatttcgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgccctgagcattaaatttcgcttccacagcaacaggatctaccgctgaaaaacgtacatagattgatggtgatactttatcttcatattccacttcagcttcagcaagggaagatccacagtctaaacaccagtgaactggttttgaacctttgtataagtgaccatttgcaatcactttacctaatgtacggataatatgtgcttccgtatcaaaattcattgtgagataaggattatcccaatcgcctaaaatacctaaacgcataaaatctgctttttgaccatccacttgctcttttgcatattcacggcatttttgacggaattcagcggttgaaatattttcgttcggtttacccaccaaaccttctacttttaactcaatcggcaaaccgtggcagtcccaacctggtacataaggtgtatcaaagcccattgcagttttagatttgttaataatatctttaagaatatggtttacagcgtgtcctaagtgaatattcccattcgcatacggagggccatcgtgcagaataaaggatcttttcccttttgatgcttcacgaattttttgatagagctttttgtcgtgccaattttgtaacatcgcaggttcacgcttagcgagatccccacgcatcggaaagcctgtttcaggcagatttaatgtgtttttgtaatcagtcattttgttgttccaattaataaaattaaaagtctttatgaaaaataagtaagcggtagaaattacccactattttgcaaaatagatcgtactatttggtttacctcttgatgatcttttatttgataaaggtaaatatttttatcctgttttaactgttcaaggcattgttgataatttactgccattcgttcaatcacttctcgctcaacaattcgagggagagtgccttctatattacgcttatcctcaaaccgttgtctattacgcataatactcaattctgtgtttgaaggtaatgcaagaatataaatttgataatcctgattttttaattctgataataattctattgctgtatcaatattattaaaggttgtttcatatattatattcaacctattttcagtcgcttttttcaataacccctttgctactcgatgagcaaaattgcccgtttttttatgagcattatctctaccatatttttcaatgtattgacttattttagggtgaatacgtctataatcatcagcttgaatagggaaataatttaactcaaaattatcatataacaacttaatacaagttgattttccactaccactcacacctgcgacaatgatggcttttggtaaatctattgaggttaaaccttgaacaaaaactctatcatcaaagagtgcttgaatttgttcttctgttggtttgacctctctcaccataatcaatgttccaaacgcaatttttgatatttatcttgcaaaatcagcacctgttcaacaacagggatcacgtccatataatgttcaggaattaaactaaaatactctaattctaaatggtgtaattgaatacgatcactttttcctatttcagtctgtaatgcccctgtcattagcatatcagcaaaagtatccgcacaaatttcgtggaaaacatcactaaacggcacataatcttgctgtaaactggctaaaatttgggcttttctttcttctgttaatctcattttatacctcttgaaagaataatctcaccgcttgtacatctttctcaatttgcaattttaactcatcaaaactcgcaaacttaatttctgaacgaaccttctttaaaaaacggacttcaatcgcttgcccataaatagaattatcaaaatcaaacaaatgtacttccaataacggctttgtcccatttatcgttgggcgattacccacattcgcaatactattaaaaatccctgctgatgtttttactttgactgcataaacaccctgaatagccgttactaaacgatttagcatcagatttgccgtcggaaaaccaatggttcgacctaacttattaccgtgagcaacacgaccacaaattgcatagggttttcccaacattttttctgctaactgcaaattatcattatgtaacgcatcacgaataagtgaactactaatccgctgttgctctaaacaatggctgtgcgaattttctacgtcaaacccaaattgctttcctgcctgttgcaaactatcaaaagtccccgaccgcttgtagccaaactggaaatcgtcaccgacacttaaatacttcacattcaacttatcgactaataaatgttgaataaattgctctggttgtaattgagcgaactgagcattaaaacgcacacaaagcaaataatcaaaaccgatttcttgtaaggcgtgaattttatcgcgtaaacgcatcaatcgtgcaggagcggtcagtttatcttgttttttggcaaaaaactcacgaggctgaggctcaaaaatcatcaccactgacggcaaacgcaaggcatttgctttctctagcaaacgcttcaaaatttgctgatgccctaaatgaacaccatcaaaattgccaatggttagcacacagcccttagaaaaatcagcacagtgagctaaattatgcacgcctcgaattaattgcatcggataaaaatagattacgttttcaaacaaaaattatgcccgattatacgaggaatggggggaaatgaaaagaaaagcataaagatattttggcgatctttctagcttatcttggtataattactgtacgcaaacgtttgcttaatgttatacttatgaataagtttttttatttaagaggattgctatgacagttacacaacttagttataaagacgctggtgtcgatattcacgcaggtaatgaattagttgaacgtattaaaggcgatgtaaaacgtactcgtcgtcctgaagtaattggtgggttagggggctttggggctttatgtgccttgcctaccaaatataaagagccgattttagtgtctggcactgatggtgtgggtacaaaactacgtttagccattgatctaaataaacacgacactataggtatcgacttagtcgcaatgtgtgtgaatgatttagttgtgcaatgctgaaccgctgttcttccttgattactatgcgacaggtaaattagatgttgatgtagcaagctctgtcattaaaggcattgccaatgggtgtgaaaaatccggttgtgcattagttggtggtgaaactgcagaaatgccagggatgtatcacgaaggcgattacgacttagcaggcttctgcgtaggtgttgttgaaaaatcagaaattattgatggctcaaaagttcaagttggcgatacgctgattgcattaggttcaagtggtccacattcaaatggttactccttgatccgtaaagtgctagaagtgagcggtgcgaaaccaacggatttactcgaaggtaaaccattgagtgagcatttccttgcaccaactaaaatctatgtaaaatcggtgttagagttaatcaaacaagcagaggttcacgctatcgcacacttaacaggtggtggtttctgggaaaatatccctcgtgtattaccagccgatgtaaaagctgtgattaatgaagcaagctgggaatggttgccatcatttaaatggttacaggaaaaaggcaacatcagccgttatgaaatgtatcgcacctttaactgcggtgtaggtatggtgattgctctacctgaaaaagatgtcgaaacggcattaacagtcttaacagaagctggcgaaaatgcttgggtgatcggtaagattgaagcattaggtagtggtacagagctggttgaaatcttgtaatttctcccaccttattcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgagcgttagcgaaggggatgggggctgagggataaaatctgtgaacaaaaaaagcggatagaagtgtaaaaaagtttacacaactgtccgcttttattttgagattgacatgaggttgtcatgtcaatctttttttgggggattagatgactaagatgccctcttgaatccagactgcatgtttattgtcattattcatggtataaacataatatttgataccattttctgtgactgaacttacagacttattccagcttgccccagatagtccaccagatgcgtctcccaatttgcttgaactaacattagtatccgtcaaccaatcattattgttgttacccaagtcaactttgactttgttgccgttattcacattcaatcccttgtagattttcactgggccttctaagcctgagtttttcaaatctccatatctaatgccgataactgcgccattatccattaactctatgcgctcgaagcctttcactttgtctgtggttgctcttacgcctcccgctatgcggtataagtcaatgcctgtgcccccgtcaatcaacgagcctgcacctataccttttgagtcttggcggaaggtgtcgttgcctgagcctaggttgattcttgagccttcaccaatttcggtattccatgcgatggttccgtttcctgcaatggtttgaccttgctcgtttttactgtagtttttgatttctacaatgtcgtctcctgagcccatgttgacacatgatgacgtctgtgccttgttgacgtaagctcttatatcttgttcctaggtcgttatccaccactaaggtgtcgttgccttgttggaagttgaagtcgagcttgtagtttttacctgattggtcgttgatgatacctagactttcatgcacgtagacagtatcattgctgttaccccaagtatattttgcacctgcgccatcttttgatacagaagttggcttgctgttgccgtattttccttcttgtacctgttggagaccccatgttgggtcgttaccccagtcttggtagacgtctgaccatctgtcttcccaccaccataatactttcactcggctataacccacacgtcctgtcggtgttccattaccatttcctacgacatttgtgtattccactttgtctgtcgtggtggtgacgtccgcactttgggtgattctgtcttcgttgttatacgattctatcttcacttggcttctgtctttcactgcgtctggtgatagggtgactttgccgtcagtttgcgacaattgaacaccgtttggagcttgagtattgttgctaccatccacctgtttcagtttccagcctccgttctctttttcatatacaagcgttttggttttgttttgctcatccgtgcaagtcaacttgaacttgttggtgttctccttcggtgtcactattgcgccgcctcggttagtaccgtcaatctctgctgttgatttcgctggttgtggttcctgagccgcttgagctgttgcatttttacgtgcaataccttggctatcaagtgctgttattgtgacgttggttttgtcttttactgcacttggggcaaaggttacttcgccagtttgggcattcagtttaattgggccattaccgccgttagtatctacactaataccattcatttgcggatttttagttggatccaatttccattgactattctcatacttgaaccaaatcgttctgtttgtaccatcaggttgttgatagtccacttggaaggctttggtttttggctctccattagaaccttctctcggtttaacgataacgccaccttgagcagagttgtcaactgttgcttttagttcgtctagctcttctactttcggtgcaggtgtcggtgctggggtcgttgtggttgaaccaccactgcttgtgccgctgcttccgctagttgagctagtaccacttccgcctgttgcattggctgctgctggaccagttggaaccgatgctgcattgaatgtgagatctgtaagagtaatacctgaaccagcccaaggtgttccttcttcaccagtatacatctcatccattcgacctttggtagaatctggaatagttgtatatacaatatatgttactttattgttaggtgactgtgccgtcgtcttgaaggatatagtcgcttgcgtcagctttttgtgcaccgttagatagcgttgcagtgtcatcgacaacccatttaccttggtctaggtctttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttcacaaccattctgtcgttatcaccacccggtttcgctacgatgtcgccggagtttggttggtcgttttgaacgccgttaactgcctctgttctgcccgcagtgattgtcggtacgtctgtgcgaactttgctgtattcaggctcattggctgttgcgtctgtaggtcctttgttcagttctttagtttctgcagcgttttgtttgtactgtggcaacaaatttatccccaacggctaatggagttgctgtagattcgctaatatcaaacttgaacttaccgcttgttaccgttgtttctgcaattggttgtccgttagtttgaccttctttgtagaggtaaactttggttccatctgcttctgtgcttgttccttcaatgatgactcgctcaggatctttgtctgccgttgctgatgtatcaatcgccttgattgaggtaatcactggcttatctgatttcacatcaaacggagcatctttcttgctggtttcactttctgcagatgtgcgtcctgctacatcagtcgtggttgcactgacagatgttttatctgctactttgtcttcaggaatcgttacactgactttgccactttgatcagtggttggggtgagtttaagtgaatctttttcatcttgaacccagtttccgccagtataggtgtaagtcaatgtcgtcggtgtacccgctgttccatcagtattttctggggtgtagttgatggtgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtgcagaatgcattgttttataagggatatttgatgggaaaagaactcatttagttgaaaaagtgaagaaaagggagaaaaactaggtggtgtgattgaattgagtgcatttttatcaagagaagggcatttttagccaatgctatcatatgccctataaatacctacgaattaaaattgctcgccatatttaggcttttcaatatttgtaaaggttttattctgattctctttaatcatttcagaaattttttgcgcagaatctttaatacccatcgcttcaaaagatgtttttagtaagggtaatgcttgatatgttgcctgagtatcgggatataaacgtagcatttcatctactcgattaacaaccgcaacataagcctttctttccatatagaattcggcgatttttagttcatgttcagcgaggcggtttttcaaataaatcatccagttttgagcatctgaggtgtattggctatttggatattgaaaggtaattgtttggaaattaccgtacgcatttcgaatgttctctattgctctagaggccctgttaattccgaagaaatcttgtatccagttatcgcctaaacgtgcgtagtttaatcctgcaaggtagtaaacataatccatacttgagctgtttggatgagttctcgcaaaacgttctgcaacctctaatgctttgtaatattcacctaatttatagttcgcataaatcaaacttaattgaacttgctcatcataagccccttgatttgagcgtagatcaactgcatctaaatagcgaattgcattgttataatcaccatcttgtaaatatgcttgtcctttgtcataaagttcttgagaaggaataccctcaaattcatcttttttagaacctgaacaaccaacaacaagaagccctgcaaggactaaagaagcaagagaataaaatttacgcataatgatttacctataaaaagtgtctgcaaactgaaagttaatgtacaatgctatttgacccagcattgtccgtgaaagttcatacgataatgcccttattctacaataagaaaacataatttggaattttatcattaatgactcaacaaataacattacaaactgaagtcacttcagatttattaggtgcaagattagatcaagctcttgcgcaacttttccccgattattctcgttcacgcattaaagtttggatcgaaagtgatctcgtttcggtcaatggcaagattgtgaataaagctcgtgagaaagtattcggcggtgaattaattgaaattcaagcggaaattgaagaagaaatccgttttgaaccgcaagatattccattaaatatcgtttatgaagatgatgatattttagtgattaacaaacctaaagatttagtggttcaccctggggctggcaatccagatggcacggtgttaaatgctttattacaccattatcctcaaattgcagaagtgcctcgagctgggattgtacatcgtttggataaagataccacaggtttgatggtagtagctaaaactgttcctgctcaaactcacctcgtcactgctttgcaaagacgtgaaattactcgtgaatatgaagccgtagcaagcggtattatgacacaaggaggcaaagttgatgaaccaatggctcgccacccaactaagcgtaccgcaatggctgttcacccaatgggaaaacctgcagtaacacattatcgtattatggaacgtttccgtaattacagccgtttacgcttacgcttagaaactgggcgtactcaccaaattcgtgttcatatggcacatattgcccacccattgttaggcgatcaactatatggcggtcgtcctcgtccacccaaaggggcaagcggtgagtttttagaggttttacgcaattttaaacgccaagcattacacgcaacaatgcttcgcttgcatcaccctatcactggtgaactgatggaatggcacgctccattacctgatgattttgttgaattaattgaggcattaaaagcagattatttgttgtataaagatgagttagattattaaatgagaaaaaaatccccaaacctatgtctggggataaaatgacaaaaagtattaaatacttaaaatttaaccaaggaaatatctatgaaaacagtaaggaatctctctatttgtattgaatggcggtgagagggggattcgaacccccgatacagtttcccatatacacgctttccaggcgtgctccttcaaccactcggacatctcaccgaatcaataaaaaatgtgcatttaaatgcacatttgaaagatatgcgaactatactgatttttcatagtctaatcaagcattttcttcacaaactaaaataaattgtgaattaatgcccgtgtcccagacaatttgttgatgccggaacttcttcgcctcgagctttccattctgttggggtgtaaagatgtaatgctaatgcgtgaacgccgttggctaattcttcagcaaggcaagtataaacggcttggtggcaagcaacagggcgtttgttttcaaatagctcgctgaccattgtcactttaaaatgtgactctgagcctcgtccagaactatggcgatggctctcgttttcaatataaagtgctagtggggtaaattgtgcttttagtttttcgacaatagtatgttcaacagacattttttatccttttggtttggaaatttaggtggaataatactatactttgcattacttttaattgagattatcaaggatcctatatgaaattcaataaaaaaacgtttttagttgcaaccacccttgcaaccgcattattagccggttgtcaatctcagtcaaatacactgacgtttactacgccagcaccgaccgcaatgtttaatacccataatcaaacagcgttagtgaatgtgagtacacaagatctgcgtacatcggctgaagtagcaagctataccagtgctggcaatgttaatcgtttaagtgttgtgccaacggtgacacagttataccaacaagcaatgcaacaaaatctgaacagcaaaggttttactgtagtttctggtgctggaaatgcgaatgtgattgtgaatattcgtcaattttttgctaatgtggaacaaggaaatgttcgctataaagtaaccgctaatgttggtgtagaggttgttgttcaaggtgcgagaggtcattttgcgaaaaactttaatacctcccgttcttatgaaggggcatttggtgcaaataataatgaaattcataaggtgttaggtcaagcgtatagtgagtctattcaggcaatctataacgataatgaaattagtaacgctattcatcaatttaagtaacaatgtagaagcggtaagattgagataatcttttgagattatccgtattgtgtagcacttacacaaaaaatagtagggacgccacgcttggcgtccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctaaatttgcaaacagcttatattcaacggacgctaggcgtagcgtccctactgtatgaaaaagtttgcgtatttgctacctgatactgcctgcttacctttaggaacgaacctacccacatttcaatagcaataatgagaataccaagaatttaccacccagaagcccttgctggcaaaagccactgtattttgagtgaagatgcctttaaccacgttggacgtgttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgaagatgcctttaaccacgttggacgtgttttgcgtatgggcgagggggctgaacttgttttatttgatggctctaaccatatttttaatgcgatcattgataacgtatccaaaaagcagatcagcgtaaaaatccaaaatagccaactggacgatagagagtcgccgttacctatccatttagggcaagtgatttcccgtggagatcgaatggagtttaccattcaaaaatcggttgaattgggggtaactaccattacaccattatggtcagaacgctgtggtgtaaaattagatggcgagcgtcaagataaaaaaatccaacaatggcaaaaaattgcaatatcggcttgtgagcaatgtggacggaacattattcctgaaattcgcccgataatgaagctgaccgattggtgcaaagaacaagatggaatgctcaaactaaatcttcaccctcgtgctaaatacagtttaaaatcgttactgaatgtaccccaagagggcgtacgtttgttgattggttcagaaggtgggctttcccctgaagagattgcaatgacagaagcggagaattttacggaagttttacttggaaaacgtattttacgcacagaaacggcttcacttgccacgatcacggcattacaaatgctttatggagatctcagctaaatgatgaatttacaaggacaatttttgattgccacgcctgatatgaatgatgactattttgatcgtgcggtgatctacatttgtgaacataatgaacacggggcaatgggcataatgatcaactcaccgacagatctatccgtgatggaattgctcgccaaaatggattttttaatggcaaatgaacgcaattacaccaaagatcagctggttctcagtggtggacctgtggggcaagagcgtggttttattttacataccgcaaccgatcagctctttttacatagctatccaaccgctgatgatttaatgctgaccacatcgggagatattttagacacctttgggcgacaagatgcccccgctgattttatcgtctgcttaggctgttgcacttggaaggctgatcagcttgagcaagaaattgcatgcaattactgggtaactgcccctgcgtcccataaaattctttttgaaacaggttatttagatcgttggagcgaagcgaatgcattactgggtatcgaaggcattttagctaaagcagggagagcctaatgagccaaactgtgcttgcctttgattttggaacaaacagtattggctgtgccgttggacaaagtattacgggcacggcacagggtttgtctgcgtttaaagctcaagatggcataccgaattgggagcagattggcaaagtgattgcacaatggcaaccagatctcttagttgtcggcttaccgcttaatatggacggtacggagcaaccgctcacgcaaagagccaaaaagtttgccaagcgcctaaacggacgctttaatttgcccgttgaattacaagatgaacgcttaaccaccgtagaagcaaaatcagaaatttttaccagaggcggttttaaagccctaaaaaaaggcaaagtcgatgcgatttcagcttgtttaattttagaaagttggtttgaacagcaatcataaaatatagcagttttgaatctataaactttgatacaacttaaacgcttgcccatcagacatactcgcaaggtagtcgcaaatcacccttgggcgttgctgttcatctgcttgtatccaacgttctgccacagatttaggcagtaagcgggttggatcgcaacttagcatatcaaacagatccattaaaatttgctgacctttatattccacccgttgcgttttgacatcacaaataacatattgatagacaaagtttttaagtacttctaacaccgcttgtgcttccgttggtaatatcgtattaaaacgcagtaatggctcttcaaactctgctgtttctgtccattttacatttgtcacaaaataattgactagcgctccaataacatctttgcgttcgtagcggtgaattgagaacaattttttgctgatgtcaggtaacattttttgaatccaagctgatttacattgagagaaggcttgttccgcattttgccacgattgcggcgtgaccattccgccaacaatcgcatcttctaagtcgtgaaccccataagcaatatcatcagccagctccataatactgcaatctaaggatttataacgggttttgtgggggaattgtggatcttggcttatttcaatttgttgaaataactctctatctgtaacggaaagcggttcaagtacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaaaaaagtgagcgtctgcacggaaaatccccttgcttgtttttagatcgtgcaagttgatataacggctatttggaatggcttttgggctttgtggctgagttaaatcaataaaggtaggatatttgatgatacccaacaaggtgcgacgcgtcagattcattcctgcattttgggtataaggctcaagctgagtgacaatgcgaaaggactgagcatttccttcaaaaccaccaaaatcctgcattttataattcaatgccatttcaccgccgtgcccaaaaggggggtgtccgatgtcgtgagcaaagcatagggattccgtcaaactacgagaaggcaataaagcggtgagatcttcattgaattttgcaaatgttggatcggaacagaccgcttgaaagccttgcctatcttccgccaattttgctcttaagctactgccaatttgggcaacctctagagagtgggttaagcgtgtgcgataaaaatcatcttcgcccactgcgtgaatttgtgttttagcttgtaagcaacgaaaggcttccgagtgtaaaatgcgtccccgatctcgttggaaaggggaacggtgatcttgttcgcgttgtttgtctgcaataaaacgtgatgtccaagctgaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttattttcctccttagtcacagtttaggctataatagcggataattctttttgtttaaaccttattcaaatggcacttttttattctgataattccgcaaaaaaatccgcaaaaccgaccgctttacagatctttcatatccaatctttagactatcaaggattaggcgtggcgaaagtcaatggcaaaacgtggtttattgaaaatgcgttgccgaatgaaaaggtggaagccaagattattgaagataaacgccaatatggacgagcgacagcggtacgatttctacaaaaatccgcagatcgccaaacgccattttgttcaatctatagacaatgcggtggctgtcaaatgcaacatattccactggctttacagcgagaaaccaagcaacagacgctttttaaccgtttacagaaacttcaagcagagcctatcgcatttgagccaatgcttataggacaaggtataaactaccgccgtagagcaaagctgagtatggtggttcaaaaaaataccttagtggtcggctttcgccaagcgaatacgcaagagattatccctctaaatcattgtgatattcttgagcctgaacttaatacgcttttacccaaattacagcaactttttgccagttggaaaaataaaaaacagttagggcatattgagctggttcaggcggataatggggtggcattgctgttacgccatatcggcgaacttcattcacaagatagtgataaattacaacgctttgtggaacaagaagatcttttgttattcgtgatgacagataaagatcagattagtcagtggcgtggtgaagttccttattatcaaatcaacggcttaacgcttcacttttcgatccgtgattttattcaaatcaaccgagaaatgaacaagcaaatggtgaacaaagcgatagtgtggctcgatctgcaaccgacggatcgagtgcttgatctcttctgcggaatggggaattttaccttgcctatcgcaccgtttgttgaagaagtggttggtatagaaggggttgagccgatggttgcacaagccaaacagaatgctcaaacaaatcagattaacaatgcgaagttctaccaaacggatctggataaaccttttgtggatcagccttgggctaaagcatattttaacaaagcactactagacccagcacgcaatggggcttactttgccttagatcatctttgcgaattacaaccagagcggatcgtgtatgtttcttgcaatccagcaactttagtcagagatgccgaaaaactgattgcaaaaggatatcgtttaagccaatccgcaatgattgatatgtttccccatacggcacatttggagtcgatttcgttgtttgaaagaagaacaaagaataggttctctaattaatgaattcctatgtagactaaagttataatgttcttacttttgtcgcagccaaagtaaactatttttcatatatggttaaaatagaggagatgttagatacaaatctagaacatttttttaacaaaaaagcgatttttaataaaaaaaagtattgcatttcataaaaaaacttatatattccattttgtcgggtaaaaaaataacccctcaaacacaacaaaaaacaactatcacttggagtgaagcaatgaaaaaattaacacaactctctttattagcattggcagtggcttctgggtctgcaatggctgcaccaaaaacctttgtttattgcttggaagcatcaccttcttattttagcccagcattaggtactgatggtgcaacactagatgcaagtggccgtgccatttttaataaattaaccgattttaaagaaggtgaaaccaccgttgttccatctttagcggaaaaatgggacgtttctgcagacggtaaaacttacacattccacctgcgtaaaggggtgaaattccacactaccaaagattttaaaccaagccgtgattttaatgcagatgatgtacttttctcatttaatcgtcaattagatgcaaatcacccatatcacaaagtttcgggtggtaactacgaatatttcgttggtatggatatgcgaaatatcattgataaagtggaaaaagttgatgattacaccgttaaaattagcttaaaagtgcctaattcaccatttttagcaaaccttgcgatggactttgcttctatctactcggcagagtatgctgataagatgttagcagcaaaaacaccagaaaaattagatagcaatccagttggtacaggtccgttccaatttgtggattaccaaaaagactcaaccgttcgttacaaagcctttgatgattactgggcaggtaaagcgaaaattgatcgcttagtgttctctattacgccagatgcatctgtacgtttagcgaaattacaaaaaggcgaatgtcacgcaatgccttatccaaaccctgcagatattgcaaaattaaaatcagatccaaacattgaagtattagaaaaaccagggttaaacgtgggctatttagcgttaaatatgactaaagcgccgttggataaccaaaaagtacgccaagcattgaaccacgcaattaacaaagaagcgattattgaatcggtgtatcaaggttttgcaaaagtagccaaaaacccaataccaccaacaatgtggagctataatgacgacgtgaaagattatgactataatcctgaaaaagcgaaagcattgttaaaagaagcaggctttgaaaatggctttgaaacagaattatgggcaatgccagtttctcgtccatataacccgaatgcacgtcgtatggcggaaattatccaagatgattggaaaaaagttggcgtaaatgcgaaaatcgtcagctacgaatggggtgagtacttaaaacgtttacgcaacggcgaagcctctacttcaatgatcggttggacgggcgataatggtgaccctgacaacttcttaaatacgctattaggctgttctgcattagaagctggctctaactatgcgaaattctgttataaaccgttcaatgacttagtcacccaagcggctcaagaaacagatcaagcaaaacgtactgagctttataaacaagctcaggtgattttcaaagagcaagcaccgtgggttactatcgctcactcaacaacgtacttcccagtacgcaaagaagtgaaaggttatgtggttagcccgttcggtttacataacttctaccaagtagatttagcgaaataaggcaacattgtagggtgggtcttgacccaccttttagtttagttatggtgggttaagaccctccctacaaattgaaaaacgctgagatatttaatgtttcaatttattcttaaacgtcttttaatggttattccaacctttattgcgataactttgattacctttgctctcgtgcatttaatccctggcgatccgattgagatccgaatgggtgaacgtggtttaacccctgaagttcacgcacagatgatggcacagcttggcttagatcttccgttacacgaacaatactttaattatatcaagggtgtatttcagggggatttgggtaattcgtttcgtaataacgaacctgtactgaaagaatttttcactcttttccctgcaaccgtggagttagccttttttgctctgttgtggtcgctgattgcaggtattttgtttggtgtgattgcggcggtgaagaaagagtcgtggttttcccacgctatttcgtcgatctctttaacaggctattcaatgccgatcttctggtggggcttaattttaattctttatttttcaacgccattaggcttgccagcctcagggcgtttaccagcagaatactggatcgaagccgaaactggctttatgttgattgatacttggaattctgacgaaccaggcgcatttgttgcggcgattaaatcgttgattttgcctgcgattgtacttggtactattccattagccattattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcgatgttggaagtgttaggcgaagattatatccgcaccgccaaagcgaaaggcttaaacacaacacgtattgtgattatccacgctttgcgtaatgcgttaattccagtggtaacggtggttggtttaattgtgggacaactattatcaggggcagttttaactgaaaatattttctcttggccagggatcgggaaatggattattgatgcgatcaactcacgagactaccctgtgctacaaggttcggtgttgattattgctaccttgattattttagtgaatttaaccgtagatttaatttacggcgtggttaatccacggattagacatacttaaaaaatagatttatttgttggagtaataaatgtcttctcaagtagaaacaacctcaccagccccactaacgcctttacaagaattttggctctatttccgccaaaataaaggggcggtggttggtttaacttttattgtgattgttggacttgcctgcatttttgcagaatttgttgcccctttcgatccgattacacaaaaccgcagtgcattgttattgccacctgcgtggtttgaaggcggtaattctgcctatttactcggcacggacgacattgggcgtgatattctttcccgtattatttatggagcaagattgtctatctttatcggtctgttgatcgtagtgatgtcctgtattcttggggttattttaggtctgttagcaggttattacggcggcactattgatattgtgattatgcgttttgtcgatattatgcttgcaattccaagcctattattaactatcggcgttgttacaattcttggaccttcgctactgaatgcggcgattgcaattgctgtggtgtctattccaagctatgtgcgtttaacccgtgcttctgtgttaagtgaaaaaaatcgtgattatgtgaccgcttcccgtgtggctggggctggcgtatggcgtttgatgtttattgtaattttgccaaattgtttagcaccgctgattgttcagatgacaatggggatctctaatgcgattttagagcttgcggcacttggcttcttggggatcggtgcacaaccaccgacaccggaactcggcacaatgcttgccgaatctcgtggctttatgcaatcggcaaattggttggtgacaatccctggtttagcgattttatctctcgtgcttgcctttaacttaatgggtgacggcttgcgtgatgcacttgatccaaaattaaaacagtaaggggaacgaaatggcattattaaaagtagatgaactttcggttcactttggcgataaaaaagccccgtttagagcggtggatcgagtaagttatgaagtcaatgaaggcgaagtgttaggcattgtgggcgagtcaggttccggtaaatcggttagttctcttgcgattatggggcttattgatttccctggacgtgtaatggcaaattcgttacgtttcaacggacataatctgcttgatttaaaaccaaaagagaagcagaaaattgtcggtgctgatgtagcgatgattttccaagatgcaatgacaagcctcaacccaagttacaccgtgggttatcaaattatggaagccttgaaagttcaccaaggcggttcaaaagcgtggcgaaaagagcgtgcgattgaattattaacgatggtcggtattcctgacccgacatctcgtttagaggtctatccgcaccaactttcaggcggtatgagccaacgtgtaatgatcgcaatggcgattgcttgcaatccgaaattattgattgctgatgagccgacaacggcgttagatgtaaccattcaagcacaaattattgatttattgcttgagttgcaacgcaaagaaaatatggcattgattttgattactcacgatttggctttagttgccgagtcggctcaccgtattatcgtgatgtatgcagggcaagtggtggaagaaggcaaatctgaacagattttcaaatcaccgcttcacccttatacccaagcgttattaaaagcgttgcctgagtttgccgaaggtaaatctcgcttgcaatcactaccgggtgtcgtaccgggtaaatatgaccatccgcaaggttgcttgctcaacccacgctgtccgtatgcaacggatttatgccgacaaaaagagccggaactacgcacagtaaatggcagacaggtgaaatgccatacgccgttgaatgaaagtggattgccacaaccaatttagtaagatagataaatatgcaaaacaatacccaaaacccaccgcttctcaatgcggcggatctcaaaaaatactaccctgtaaaaaagggaatgtttagcaagccgaaactagtaaaagcggtggacggcgtttcttttacccttgaacgtggcaaaacccttgctgtggtgggcgaatcgggctgtggtaaatcaaccttagggcgtatgctgacaatgatcgagccaccaacagaaggggaattgttctacaacggacaaaatttcttagtcagcgataaggaaacagaaaaattacgccgtaagaaaatccagatcgttttccaaaacccttatgcgtcgcttaatccacgtaaaaaagtcggggcaattttagaagaacccctgcttattaataccgaattgtctgcacaagagcgtaaggcacaagtgttagaaatgatggcaaaagtggggctaaaacctgagttttgcgaccgctatccgcatatgttctcaggcggacaacgccaacgtattgcaatagcccgaggtttaatgctgaaacctgatattgtggtggcagatgaacctgtgtcagcccttgacgtatccgttcgtgcacaggtattaaacttgatgatggatttacaagaagagcttgggttgtcttatgtgtttatctctcacgatttatcggtggtagaacatattgctgacgaagtgatggtaatgtatttaggacgttgtgtagaacaaggcaacaccaaagagatcttcggtaacccacgccacccttacacccaagccttgctatcagccacaccacgtttggaagcggagcatcgccgagagcggattaaactcaccggcgaattaccaagtccgcttaatccaccgaaaggctgtgctttccacgcccgttgccgtttggcgacagagcgttgtaagcaagaacgtccagagctaaaaacctatgaaaacggcacgaagatagcttgttttatggtggagtaagaattttatatttgttgtacgctttattgccttactctatagtaaggcaatttaatttctaaatctaaaccttcctcgactatatctcgttttcatcaacgccagaatttgctctttttcgcttgataccgcttggctactctgtttagccaccgtaagcgaatgttgaatagagtgagcgtgagtaatggcaatcgccaaagcatccgcagcatcagcttggggtttggcggaaagttgcaaaatacgtgtaaccatatcttgcacctgcactttatctgccgaaccaatccccacaaccgtttgttttactaaacgtgcggcatattcaaagacaggcaaatcgtgattaaccgcagcaacaatcgccgttccccttgcttgccctaatttcaacgctgaatccgcattttttgccataaatacttgctcaatggcaaacatatcgggttgaaactgggtgataatttctgtcacccctgcgtaaatacgttttaatcgagttggaagatcttcaacagaagtacgaattgctccgctaccgagatattctaaatgccgccctgtttgacgaatcacgccatagcctgttacacgagagcctgggtcaatacctaaaataattgccattttatgtccaaaaagaaagtggatttgttattcacaaacccactttatagtcaatcttaattagataatcaacttattttgcaacagtgcagtttttcgcaagaatttgattgtttgcggtaaacattacgggcactgttgtttcagctgttttcgcattaaagcccatatctagactccatacctttttaccagacacaaatttcacaccgtcttgataggttgtatctactttcagatttttacctaccacttttttgttaatggttacagttgcagttgatggctcgccattgttgaaagtataaaccgctaaaacaggttggtttgttttgccatttacgctacaaatgtaagcaatagtttttgagcctgttgtgatattttttgctgcagttgtactatcaacagcagtgctacctgcattaccctcaatatttgctgttgaagatgcaacatcagaaactgttgaacaagctgtaagtatcgcagctgctgcaaatgttggaagtaatttaactaatttcattgcttttcctttgtattgattaaaaagatcgctctcttagaaaaggaaaaaatgggaaagttcaaaaaaataatctcaagctaaatacttgagattactttttattcatttttaattaaagcaatgcagccacttcatcactgatttcgccgttgtgatacacgttttgcacatcatcacaatcttcaaggcggttaattaagtctaataattttggtgcagtttctgcatcaagttggactgtggttgatgggatcatcgtcacttctgcattttcaactttgaaacctgccgcttcaatgccatcacggacagaacctaagtcttcccaagcagtatagatctcaaatgaaccatcttcttgtggctgaatatcatcagcacccgcttcaatcgccgcttcagttaatgcgtcttcgtctgcacttgcgattaaaattaaaccttttttgctaaataaataacccaccgaaccttcagtccctaagttaccaccacatttagtaaaacttggacgtacttgtgagattgtgcggtttgcattatcacttaaacactcaaccattaccgctgtaccacctggaccataaccttcatacactttggtttccatattggtatcatcgccaccgccaacaccacggtcgatagcacgattgatggtatcacgtgtcatattattcgataacgctttatccacagctgcacgcaaacgtgggttagagctggtatcgccaccacctaattttgccgctgtcactaattcacgaattaatttagtaaaaattttaccgcgttgagcatcttgtgctgctttgcggtgtttaatgttagcccacttactatgacctgccattctcttgtttccttctttattatgttttgaaaaaatccccctctttagcaaagaggggttaggagagatttggtagaactgcttctcgctcataagagaatttgacattgctatcaaatctcccccagtccctcttttctaaagaggggagttgcttgttaaatattttgcaatcgcttcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcattagtactcgctgagtttttttggcataaatcaccacgagaacagaatagggatttttgtagttcatttttatgtactatacaagagtttttacatcggatatgtgcgctcgacctttatcgtttatggtttttcagcatgtgctagaacattgtaaaatttcaaagagtaaataacaagattagatactgaaatgaattgattagtcaaatcgtgcgatttttttctgagaaatgaatgcttaaatttatgctaaagcggtgagattttcataagaatacgatttcaaatttcccttatatcaattttttttgttatcctaaccacaatgtaattgaatagacttatcttatatgaaatttattagaaaaaatgctgtatcgtgcatcatgttaagtagtttttatctataagcacttatgcaaatcccttgaaaaccatcttacagcagaatttatcaaatgcacctgaagtgaaagaagcgcttgcaaacgttgaagctgctcagaatcgtgttgaacaaagtaaatctcaacattttcctattgttagcgtaacaggttcaaaaactttaagacagtatcataagtatgaagataattatggttcaaccaaaatcatccctggtattcaggctgaaatgaatatctttgcttttggcgctattgagaaagatattgaacgcagttataaagagaaggagtactataagcatacctataccgctactcaagaggaaatagcgtatactattggacaactttatttaacggcactgaatatgaaggaagccatttctgtaatggaaaagagcttatttcgccaccagaaaattttacaggatttggatattatcatggagaatgatgaaggacgagaatccgaatttgttcaagctgagacacgtatgttgatggttcaacaagaaattaataattatcgacaaaaattattagctactttgaatacactatcaaaatatacaaggactaaagttgttgaagaacaattaaggacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctccaattaagtgatcctttccttcagttgaaggaagaacagctttctccttctttattttttataaataagaaggagaatgtttattttgtcacatatctatgattaatttattctttctgtattggttaatatggttatgttgacatctactctctactcatatttagttcttgtgggagtgaagctagtaatcatatagataataacttattcattaatatatgtcttctttatataatattatcgataggtagaattaaggacaatgcaaatatattacccaaattatcaaggatctgaccgcttgttagatctcacctctccgaaaattatggggattttgaattttacccctgattcgttctccgattcgggcaaattttttacccttgataaagccctgtttcaagtggagaaaatgctcaatgacggggcggatattattgatattggtggtgagtccacccgttcgaatgcagaaattgttacccttgagcaagagttggaacgggttgtgccgttggttgaagcggttcgcaagcggtttgattgtttgatttcggtagatagctcaaaggcggaagtatttcgtcaatctgcacaagttggggcggatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcaggcattcccaaagagcatattattttagatgtcggctttggttttggtaaaacggtacaacataattatcaactgctaaaacatctaaatgcctttgtagcttcgggctatcctgtgttagctgggctttcccgtaagtcgatgatcggcaatgtaatcaataaaccagtcgatcaacgtgtagcaggcagtgtcgcaggggcattgctcgcagtgcaaaatggagcgaagatcgtgcgagttcacgatgtagcggaaaccgctgacgcgttgaaagtgtggcaagcgatgaatgaatgtgaataaaaaggaagacaaaatgacaatactctacggcattaaaaactgtgataccgtgaaaaaagcgatcaaatggcttgcggataacgacttaaacccacaacttcatgactaccgtgtcgatggcttagatcctgtttggctggctgaaatggcagagaaatttggttgggaaaacttagtcaataaacgtagcaccacttggcgtgggcttgatgatgaaatcaaaaataatctcaccaaagagctggcactaaaggtgttaaacgaacagccaaccttaattaaacgccctattgtgattgctgatgatgctgcgttgattggttttgatgagaaagagtatcaaaaggtatttatgaaatgatacccaacatattaattatgttgagtaaaaggggcaattttaagggctctctgtttattcaaaggtattggataggatttggatcatgagttatattgtagctcttactggcggtataggaagtggtaagtcaactattgctaatctttttgctgcacttggtgtgccagtgattgatgcagatattattgctcgaaatatcgttgagaaaggcagtcctttactcgctcaaatagtagctcattttggcaaacaaattttgtttgaaaatggtgagcttaatcgtacagcattacgacagcggattttccagacagaatatgagagactgtggttaaatcagttacttcatccagctattcacacagaaatgttaaagcagttgaatgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggaatgaaagccaatctccctatgtgctttgggttgttccattattaattgaaaaccagctaatggcattatgtgatcgtattttagttgttgatgtattgcctgaaattcagctagaacgagctatgaagcgagataaaagcaatgttgaaatgataaagagtattatgctatcacaggttgatcgtcaaacacgattaaactatgctaacgatgtgattgaaaataatttaccttttggtgataatgaagtccatctgactcatcaagtggcaaaattgaatgaatattatttgactctaagtaaaacaaaggggaaatagatcatgctcgtcgtattctgcccaaattgtggcaaagaagtggcttgggttttgggcaataaatatagaccattttgcagcgaacgctgccatttagttgatcttggcgaatggctcaatgaagaaaatcaagtccttgaaagtgatattcagtctgcagatgactatgatatggtggtaagtgagggtattttctaatgaaataacaaactaaaccgttcaatgccttgccaagcctcatcgctaaattcttgttttacctgtttttccaattcggcaagggattgaatgagttgatagagtttatggtaagttaaacgttgtactgcagcttgataaaacccacggcggttttgccatactttcaagcggtcaaattcggctcgtaaattaccgctatacagaggtcggtgactattgataatcggctgtggtgagcgtgtcatttccagtaataaaagtagctctttttgtacgatgcgtagtaacaccactggttgtatctcttcattctgcagatgttgaagcactcttaatgctcggttaatttttccttctaataaggcatcaacccattggaatggggtgaattgtgccgattgttcgatcacttcttttgctcggtttaatccaatcttttgttcagcaaaacgaagttgtaacatctgcaatgcttgttttagtgccagtagattgccttcgtagctataacaaagtaattgaatagcatcaggctcaagctgcaactgcattgttttagctcgatgttgtagccaaataggtagttttgtaatatctggtgtttgacagtttacgactacggcattatttagttgtacaaaccagctctgtttttccattgctttggttagttttggttggtgcagaacaaaaagtaaatccgtgtgagaaaaagccagtagttcagatagctgtttttgctgtgttacagttaggttttcaggcaggttaagaattagaatttggcgattaaaaaaaagcccatttgattgaaccaggtcaaacagcatatcccattgggtatcattggcaatggtaaactcttgtttttcatcaaaatcctgtaaacgagccgtttgtacaatacagtcttttgcttcaccaaccaataagagatcctgcccggtcaataaataaaatggttgtaaacctttattgagggcaggttctaatccttctgggaaaatacgttgcatcatcttatttcgtatttgctaactctttttgtaatcctgcaactttaataagaagctggcgagaggcttgttcatacatttgacgctgaatactttcttgttcttctgattttgctaaagcggcacgagagtcgtcgaagaaagtacgatgaacgctagtttcaatcggatatgcccctttatttgggattgttaccgttgctttcaccgttaaactgaggattttttcagcttcacgcgcttgtttaaagactgacgcaacacgagagctactttctgttgcgtttaagcgtaaactcgcaacatcagcggatttcggcacgatttgaatgttactgagtaacatttggttacgcaaaatgcgtgacatatcgctgtactgatccgcactttcaaaactcaaagtacgcaactcttctgggaagagttcattatttttaaaatgccaaccgcaagcggttaaaaatagcacacaaatgagagagagtttttttaacataccatattcctattttgtagggtgggtcttgacccaccatatacgatgtagattagatggtgagttaaaacccaccctactattatgctttcaccgcaaaactcaacatcttaaacggtacatagatctctttcacgatttctacgccttcaagatatttcgccacattttcatcggctttcgcaatcgctttgacttcatcttccgttgcggttgtagacacggtaattttaccacgcactttaccatttacttgcaccacaaccagtttttcatcttctaccattgctttttcatctgccacaacccaaggtgcaaagtcaattgaaccctcattgcctaaggcttgccatagttcaaagcagatatgcggggtgattgggtagagcatacggatcaccgcatttaatgcttcagccatcacggctttgtcttgatcattaacaagcggtgctttggtgagcttattcatcaattccataattgccgcaattgcggtattaaaggtttgacggcgaccgatgtcatcactcactttcgtaatggttttatgtacatcacggcgtaaatctttttgctctttgcttaatgccgtaggatctaatgcaacagtggctggcgattgtgcatactcatacgccaagttccaaagacgacctaagaaacgtttcgccccttctacgccagactcttgccattctaatgtcatttccgcaggggaagcaaacatcataaatagacgcaccgtatccgcaccatatttttccaccatttcttgtgggtcgataccgttgtttttcgatttcgacattttggtcataccgctgtgtaccaacgcacgcccttctttgtcaaaggctttcaaaatacgccctttttcatcacgttcaactgtcacttctgttggcgacacccaaatacgttcattggttgggctggtgtagtaataagcgtccgctaacaccataccttgacagagtaatttttctgtcggttcatcgctagtcacgaaaccggcatcacgcaataatttgtggaagaagcggaagtagagcaagtgcattgttgcgtgttcgataccgccgatatattgatccacaggtagccagtagtttgcttcttctttgtctaacataccttgttgatattgtggcgacgcataacgtgcataataccaagaagactccataaaggtatcgaaagtatctgtctctcttaacgctggctgaccgttataagtggttttcgcccattctggatctgctttgatcgggcttttcacgccgtccatcaccacatcttcaggtaacaccacaggtaaatcttgcattggtacagtcacagtttcgccattttcaagggtaagcattggaattggcgccccccagtaacgttggcgagaaacgccccagtcacgcaagcggtaattgacttgacgtttaccgatccccattccttctaatttatccgcaatacctttgaaagcgccatcaaaatctaagccatcaaattccgcagagttaatcaatttaccgtgttcagtcattgccgctttgctgaaatcccattcagaaccatcaagcggtgcgatcacctgtttaattggtaaattgtatttttgtgcaaattcaaaatcacgctcatcgtgagcaggtactgccattacagccccagtgccgtagtgcatcaacacaaagttagcgacccagacaggaacttcttcgcctgttaaggggtgaatagcaaacaaccctgttgccattccttttttctccattgtggcaatatccgcttccgccactttggtgtttttcgcttcttgaataaaggcagctaatgcaggattgttttctgctgccagggttgctaatgggtgggccgccgccactgccacatagctcacaccaaagaaagtatctggacgagtagtataaacaggcaaggtttgatcagtgcctttcactttaaaagtaatttcaaccccttcagaacgaccgatccagttgcgttgcattgttttcacttgatctggccataacggaagacgatctaagtcatttaacaattgctccgcatagtcagtaattttaataaaccattgcggaatttctttttgttccacaggggtatcacaacgccagcaacagccttcgtggacttgctcatttgctaacaccgtttcatcattcggacaccagtttactgtcgatgttttcttatatactaagccttttttgtacaattcagtgaagaaccattgctcccatttataatattcaggacggcaagtggtcacttcacgatcccagtcaaagccaaaacctaaggccttgagctgatttttcatatattcaatattttcataagtccattttgctggtgcagttttattttttaccgctgccccttctgcaggcaagccgaatgcgtcccaacccattggttgtaacacatttttgccgttcatacgttgataacgggaaaccacatcgccgatcgtatagttacgaacgtgtcccatatgcagacgacctgaagggtatgggaacatagataaacagtaatattttggtttgctttcgtctttaattgctttgaatactttattttcagcccagtactgctgtactttaggctcaatcgcactcggattgtattgttgttgcatcatcttcattcctcaaatttgtcgaaaaattgcggtatagaatagcgtaaaaatggggatttttgaaatgatattaagttcgcggtataaacaaaattaaatagtgaagcaaactccgtagatgtaaattagtcatttgttcatgctttaggctatgtcagcaaagcctaaagccccagcaaaattacctgatcgagaaaatctcagggaaattttggcttacaacattcaaacgttgcgtgtgcaaaaaggttggtcacaggaacgattagcgaatgagtgtgagttagatagaacttatgtttcagcggttgaacgttgccgctggaacgtttcgctttcaaatattgaaaagttagcaactgcactttcttgtccagcttggcagttattgaaataccccagggcaagatcgcatctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatacccagaaaatagcaatcaaaatactgaaagaaatttagatttgtgttaaaattcgctggctttttcgtccgcccgattgttagggcgagtaaagcaacttgcaaaaaattttgaaaaactgaccgcttgcaagcggtcttttgttttgaaaaatttacgaatttcaatgatttacacgtagggacacactgcgtgtgtccgttctattttgtattgatgatatttagcagacacacgcagtgtgtccctacgggaataacataaaccaacaagtaacctttcgtatgggttaccactgtataaggattaacaatgccaattattactttacctgatggctcacaacgccaattcgacaatcccgtttctgtaatggaagtggctcaaagtatcggtgcaggtcttgcgaaagcaacaatcgcagggcgtgtaaacggcgaacgccgtgatgcttctgacattatcagcgaagatgctacccttgaaattattactacaaaagatgaagacggtttagagattatccgtcactctacggcacacttactgggtcacgcaatcaaacaacttttcccgaatgtgaaaatggcgattggtccaacaatcgacaacggtttctattatgacattgatttagaccgctctttaacgcaggaagatcttgatgcacttgaagcgcgtatgttggaactggcgaaaaccaattacgatgtagtgaaaaaacgtgtgagctggcaggaagcgagagatacttttgaaagccgtggcgagtcgtacaaaatggcgattttggacgaaaatatcagtaaagattaccgcccagcactttatcatcacgaagaatatattgatatgtgtcgtggtccgcacgtgccgaatatgcgtttctgccatcacttcaaattacaaaaagtggctggcgcatactggcgtggcgacagcaaaaataaaatgttgcaacgtatttatggtacggcgtgggcagataaaaaacaacttgccgactatttacaccgtttagaagaagcggcaaaacgtgaccatcgtaaaatcggtaaagcgttagatttatatcatatgcaagaagaagcaccgggtatggtgttctggcacaatgacggctggacgattttccgtgagcttgaaaccttcgtgcgtaccaaattaaaacagtacgattaccaagaagtgaaaggtccatttatgatggatcgtgtgttatgggaaaaaacaggccactggcaaaactatggtgatttaatgtttaccactcaatcggaaaatcgtgaatatgcgatcaaaccgatgaactgcccaggtcacattcagatcttcaatcaaggtttaaaatcataccgtgatttaccgttgcgtatggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtatggcggaatttggttcttgccaccgtaacgaaccgtctggttcattacacggtttaatgcgtgtgcgtggctttacccaagatgatgcccatattttctgtatgccagagcaagtagaaagcgaagtcacatcgtgcattaaaatggtgtatgacatttacagcactttcggttttgaaaatattcaagtgaaactctcaactcgccctgcaaacagtatcggtacagatgagatgtggaacaaagccgaagcagacttagcagccgcattaaccgctaacggtttagcttttgaaattcaagaaggcgaaggtgcattctacggcccgaaaattgagtttgccttgcgtgactgtttagatcgtgaatggcaatgcggtacgatccagttagacttctttttaccagagcgtttaagtgcatcttatgtggcagaagataacaaccgtaaaacacccgtaatgatccatcgtgcgattttaggctcaatcgagcgtttcatcggcattatcaccgaagaatacgcaggtttcttccctgcgtggttagcaccagttcaagcagtcgttatgaacattaccgacagccaagcagaatacgttcaacaagtggtaaaacaactttctgatgctggcttgcgtgtgaaagcagatttacgcaacgaaaaagtgggctttaaagtgcgtgaacacaccttacgccgtgtgccttatatgcttgtttgcggtgataaagaaatcgccgaaggcaaagtgtctgtgcgtactcgcaaaggtgcggatttaggtacttacaaagtagaagagtttgtcgaaatgctcaaaaaacaagtgcgtggacgtgagttgaagttacttggggaagagtagtcagtttagatacactaggaggccaatgtagaggagagtaattctcctctcattactaataggcatagtagacaaaagtattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtatttattcaagatggttctactaatgtagcgcctttctatgacaacggtgctattggtattggttatgcgagttatgttgggaatagttctgttgctatcggtaagtattcaaaagctagagatactactgctgttgcggtaggtttcagcgctgaatcaatcggacataatgccgtagccgttggatcgaacactgaggcaacttcaagctccgctgcctatggttctagagcaaaagcattaggtagaagttcggttgcggttggtgaaaatgccgagacaaataatggtgctgctagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtactaatgaagaaatcaagaccaaagcggatggttcaacaatcacgatttcgttagaggacaagattaagcaacaactggctcagattgccactaaaatgtcatcctttaagattaaagcgaataacactgaagatacaattaagaatggagatgcgatccagtttactgctggggacaatataaagattacccacaataataaaaatctaacttttgccgtcacttcaggtagctttaatactacaacaaatggcacattgtcacaaaaaagtgcagggctagcaaccgttaatgatgtagtatcggcagtgaataatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtctactatgcctactaatatagagtgctcacaaattcaccacaaatttcccaaccccaagatcatcttctttgcgagtacgattaatcacactttgagcggattcaataacacgtaaacccatctgatcttcggttctcaccacttcaccacgcaatgagttggtataaacatcagtaattttaacatccacaaatttgccgatcatattaggtgtaccttggaaattgacaatacggttgctttcagtgcgtccggttaattccataatgtctttcttagatgggccttcaactaaaatacgttgttccgtacctaacattgcacggctaaattgcattgcttggttgttgatacgttgttgtaagcggtataaacgctcttttttctcatcttccgtcacatcatcaggcagatccgcggctggcgtacctggacgagcagaatagataaagctgaagctcatatcgaaattgacctgctcaatgattttcattgtttgttcaaaatcttgagccgtttcacctgggaagccaacaataaagtcagagctgatttgaatatcagggcgagcctcacgcaatttacggataatggctttatactccaacgccgtatggttacgtttcatcattgttaaaacacggtctgaaccactttggataggtaagtgtaagaagctcactagctcaggggtatctttatatacctcaatgatgtcgtctgtaaattcaatagggtggcttgtggtataacgaacacggtcaatgccatcaatcgaagcaactaaacgtagtaattccgcaaaagaacagataccgccgtcaaaggtttcaccacgataagcgttcacattttgaccaagcaaatttacttcacgcacgccttgttcagccagttgagcaatttcaaatagcacatcatcaacaggacggctaacttcttcaccacgggtataaggcacaacacagaatgaacaatatttattgcaaccttccataatcgacacaaatgcagttggaccttctgcacgaggttcaggcaagcggtcaaatttctcaatttcagggaagctaatatctactactgaactttttccgccacgaatttggttaatcatttcaggcagacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttcacgaatatgttcaccttcttgtgaagctacgcaaccacccacaccgataattaaatcaggtttatcttttttccagtttttccagcgaccaagttgagagaacactttttcttgtgctttttcacggatagaacaggtgttaagcagtaatatatctgcttcttcaggattttcggttaattctaaaccgtgtgtgctatttaaaaggtctgccatttttgacgagtcatactcgttcatttggcaaccccaagtggtaatatgtaattttgccattttcaaataatagataaatcagtaagtaaaaaaataaaagtagagttgtttatcctttggaacagggtgtaccttattttacatgtttgtatatatcatcgctataaaaaagaaaaccacgaccaaaactcgtggtttttattcaagtagtgtaactattttgttaaaactaaaacagtactttcacctgccacaacttctccagacaatttttgaagatttgttacttcatccatatttgaaattacaacaggtgttaatactgattttgctttagattgaagtaattcaagatcaaatttgatgataggatcaccaactttaacctcttgattttcttctgcaagacgtgtgaaaccttcgccttttaactcgacggtatcaataccgaagtgaacaaaaagctcaacaccatcttctgactcaatagagaatgcgtgattagtttcaaagattttaccaatcgtaccgtttactggggcaacaatcatatcaccagtagggcgaatagcaatgccatcacctacgatcttttccgaaaacacaacatctggaacatcttcaatatttacaatttcacctgaaagcggtgcatagattttcacttccttcgcaacagcttcttttttgccgccgaatagtttgtcaaaaaatcccataatttaatctccattattaaatgaacaaaattctcgcatattttatacgagaattttgtgtttgtattcaattttagttaaggttttggtaaaactcatcaactaaacgttcaatatctgttgctgttggttgtgcaagtgctttatctgcaagagctttggcatcagcatagttgatactgcgaacaagttttttcacatgaggtactgaaattgcactcatactaaattcatctaagcccatgccgagtaataaggcagtcgctttgacatcgccagccaattcaccacacattccagtccatttgccttctgcgtgtgaagcgtcaattacttgtttgattaagttcaagacagatggggttaatgggttgtataggtgagcgataatttcattaccacgatctaccgctaaggtatattgcgttaaatcgttagtaccgatactgaagaaatctacttcttttgcaaggtgacgagcatttacagctgctgatggtgtttcgaccattacgccaatttgaagattttcatcaaaagctttgccttctgcacgaagctgagctttaagttctgcaataatgccttttaattcacggatctcttccacagaaataatcatcgggaacatcaccgcaagtttaccaaatgcagaagctcttaatacagcacgcaattgagtatctaaaatttcacgacgtactaagccaatacgaactgcgcgccagcctaagaatgggttcatctcttttggtaattctaagtatggtagctctttatcaccgccgatgtccattgtacgaagcaccacgagcttaccattcattgcttcaacaatttctttataggcttggaactgttcttcttcaccaggtaactggttacgatccataaataagaattcagtacgatataagccgataccttcgccgccgttacgcaatacgccatccacatcacggatagtcccgatgtttccaactacttcaatgcggtgtccgtctaaggtttccgctggtaaatcttttaatttagctagttcagctttttcttctgcaattttggtttgtaatgcttttgctttttcaagttgttctgcagaaggattgatgtaaacttcattgttaatggcatcaagaattaaaatgtcacctgtattgactaatgaagtaatgttgtttgtacctacaacagcgggaagctctaacgaacgagccataatagaagtatgagatgtgcgaccgcccatatcagtaacaaagccaagcactttatctaagtttaattgtgcagtttcagatggagtgagatcgtaagcaacaaggatagcttcctcttggatatcaccaagatcaacaatattcatacctaaaatgttacggatcaagcggttaccaatatcacgaatatcaccagtgcgctcttttaggtattcatcatcaatttccgcaagcatcgatgcctgcatatcaatgattttacttgcggcaacatcggcagttacaagattttcttcgatgtagcctagaatttcttcttctaattcttcatcttccaagatcattaaatgaccttcaaagattgcttctttttcttcgcctaacgtgcgtcttgctttttctttaattgctgtaagttgtgctgctgctttttcacgtccagtaaaaaatttacttttttcagattcaatttgagtgggtgtgattttatgtgtgttaagaacaataggttcttctttcagaactaaggctttaccaaatacaatacctggggaagcggcaatacctgtgatcataaattaatcctcggctagaatttagtagatgctaaatagcacgaaagactttaccattgaataaaatggtaaagtcatcaatatcaaaaggacaactattctaaagtagggattaaatctactaagaaatctacagctttctgttcgtcttcgccttcagcagaaagagtgatgatagttccttgcgcaagacctagggtctgaagtttaaataaactttttgcactggcacttttaccattagatgtgacagtaatatctgaagcgaagccttttgctgcttttacaaattcagccgcggggcgtgtatgtaagccattcgggcaagtgattgttacatcttttgagtacattgttggttcctctgttgtatatcaaataataaatggaggactttttagggaagagcctccaaagtaagtcacgggattactttactacaaaatcggtataaaaacacgataaaagagattaaataaatgataaatgtcaattattagtgtgtattttaatcaatttataaaatcgtttgcgtattttatgaattatgtgttttattttcttttttatagaattattgattgcaattacccttaaaatcttgtatttatccatactttcaattcaaacacaacttcaactttttaggagcataaaatgcaaaatgtaggttttatcggatggcgtggtatggtggggtcggttctaatggatcgtatgattcaagagaacgactttgcgaacattaaccctgttttctttaccacatcacaagcgggtcaaaaagcccctgtttttgcaggcaaagaggctggtgcattaaaagacgcttttgatattgcagaattacaaaaattagacattatcgtgacctgtcaaggcggcgattacaccaacgaagtctatccaaaattaaaagcaacaggttggaatggttattggatcgatgccgcttctgcactgcgtatgcaagatgatgcgatcattgtgttagacccagtaaaccaacacgttattaccgaaggtttacaaaaaggcattaaaacctttgtgggcggaaactgtactgtgagcttaatgttaatggcaatcggtggtttatttgagaaagatctcgtggaatgggtgtctgtggcaacttaccaagcggcttccggtgcaggtgcgaagaatatgcgtgagttactggtgcaaatgggcgagttagaagatgcagtaaaagcagagcttgcagatccagcttcatctattttagagatcgagcgtaaagtgactgcagaaatgcgttcagaagatttcccaacggcaaactttggtgcaccgcttgcaggtagcttaattccttggattgataaattactcccagaaacaggacaaaccaaagaagagtggaaaggttacgcagaaaccaacaaaattttaggtttaagtgcaaatccaatcccagttgatggtttatgtgtgcgtatcggtgcattacgctgccacagccaagcgttcaccatcaaactcaaaaaagatttaccattagcagaaattgaacaaatcattgcagctcacaatgaatgggtgaaagtcattccaaatgatcgtgaaacgacgttgcgtgaattaacaccagcgaaagtgactggtacattaactgttccagtgggtcgtttacgcaaactagcaatggggccagagtacttagcggcatttaccgttggtgaccaattattatggggtgcggcagagcctgttcgtcgtattttagtgcagttagttaaataatcttttcatctaatgatcaagcggtcagattattgcaaaatcctgatattatgtaacagttgcgtagaggtttcatccgcttgatgaattaatttctgatacagtataattgagtgaaacggcattgtgcttgcataatgttgatagcttgatgaagtgttgtaatcttttcatccaccaatgctaaatgttgtaacacttattttagttctcattgtaactcggtcagttttttcttaaatcaatgtaggttcaaagcaattttcaccgaaaaatatagtatctgactttaaatccacatcacatataacacaaaacttatcaaatagtttatatgatgccatttgtactcataaaacacaaaaaacagaaatgctaatggaagaatggcaagttttgtttagattatctgagtctgataaaggtcaaaatcaagatatagaaaaaagaagaaaaaaaactatcggaaatatttagtgataacattaataataatgagaaagaatatctggctctctatgttcttcaaacatcttatgcgataattgtgaaattaatagcatgtaaagtcattcaaactctttcgtttagtgaagatgttaagtttttctcagatcttagtattattgattctattaaattacaacgttttatggagaaacttgaagatggatatgttttttctagtggtggaattagaaacttactggaaggtgacttctattcttggtattcagataaaaaccaatggaaccaaaaaatatataatagtataaaaaatataattaaagagttagagttttattcaagttcaaattttagttatgaatttcagacgatagatatttttaaagatttatatatggaaataatgcctaatgaaattaggcatagtttgggagaatatttcactccatcttggatggctgatcatgttgtatctcgttcacttgagaaactaaacaaagaatcttggaaagctatagatccatgttgtggaagtggggtatttttaatatcattaataaaatcgatactagataaacacgaattatatagtttaactataaaagaaaaacaagagttattattaagaatactatcaagtgtatatggtattgatttaaacccactatcagttttaactgcaagagttagttattttttggctataagaccattaattgacgaacaaaaaatagaaatccctgtctatcttggtgattcagctaatataccacaaaaattgaactcgataatatagcttgttatacatataccgtagaaacaaaacaaggggattttaatattatttttccttgtaattttgttgaaagtagttctttttttgaaagaatgtatcgtttacaaacaacagtagaagctgaagaccctaaattattataccatcaaattattgaaaatatagataaagactctatcaataacaagatcaaacaaagtataaaaatattgtcaagtaaattggttgaattacataaaaatgaatgggacggtatttggattagaattacatcaaactttatgctaattgcaagagttaaagagatggatctaattttaggtaacccaccttgggtaaaatgggaatttttaccccaaaattacgctgaaaagatcaagagtttgtgtattgatagaaaattattctcaggtcaaagttatatgggagctatatcacttaatttatgtgctttaattgcaaatgttacatcagataaatggctaactaataaaggcttactagcattcttaatgccaaaaacaattatgactcaagattcttatgctggtttcagaaatttttatttatctgatggtagtcgaatgtatttaagtgaaatagatgattggtctaatgccggaaacccttttattgtaactaccgaaaagtttatgacatatttttatgaaaaaaattctgtagattactcaaatgggatacctataaatttattctataaaaaatccaatgtgaaaatcacagaagtaaatagatttcatacatttgaaaaataaaagatttctttcaaattaaagatggaatggcttatcaattaagcgaaaatagaacgggatttactttactccctgaaagagattatacaattttaaggaagctaaagttaatttctggaacttcagattataaagctaaaagctaggagtggtgttgagtttacgcctgctgaggtttacttcattgaacctgagaaaagaaccagtaaaaacactttttattttagaaactctgaattcaaaaattcagtttacaaagtggctaaaaactaaattcacattttaaatttatataaagtttggaggtgtttaagcgatttcaatgcgccgccatttgaatgtgaactataagaccgattttgtcctttgccataaattacgtgaagtgccattcaaaactcgtgatttaagcccattacaaggtgaaatcctcgcagatggtgcctaggttaattttaattgtgcaacactaacttcgccaaaaatcgctataaatagtaacaaaaagccgataaacaatggcgaaaatttccaaagttcaggcagactaagcgttgtattatcagtctcaatcaacgagctttcaatgatgattgtggggttcaaatggaactattgtggcaatgaactatactgaaaatgccagaacaattttagcattaaaccaccaattcgtgaaacaaggtggtaatattatgtgtgatgaaaatatggcgtatcaaacctatataccaaaaaacataggttaacctagtaaattctcatataatacaagcatctttaactatttatggactatttatgacaacatcatccccccttatagctattgtcgctggtgaaatttcaggcgatattttaggtgccggattgattaaagcactcaaagtacattatccaaatgctcgttttatcggcgttgctggtgaaaaaatgttaaaggaagggtgcgaaaccctgtttgatatggaagagctggcggtgatggggcttgccgaagtggttaagcatttgccacctttgctcaaacgccgtaaacaagtcattgacacaatgcttgcattaaaacctgatatttttatcgggattgatgctcctgattttaatcttggcgtagaaggaaagctcaaaaatcaaggcattaaaaccattcactacgttagcccatcagtctgggcgtggcgacaaaatcgtgtgcataaaattgctcgtgcaaccgatcttgttttagcatttttaccttttgaaaaagccttttacgacagttttaatatcccttgccgttttattggacatacaatggcagatgcgattgccttgaaacctaatcgacaagaggcttgccgtttgttgcaattagatgaaaaccaacgttatgtggcgattttggttggaagccgtggaagtgaagtaaatttcctagctgaaccatttttaaaaacagcacaactacttaaaactcaatatcctgatattcaatttttagtgccgttagttaatgaaaaacgtcgtgaacaatttgaagcaattaaagaacaagtcgctccagaattagatgtaatatccttagctggtaatgcgcgcgctgcgatgatggttgctgaagcgacattattagcatctggcacagccactcttgaagcgatgttgtgtaaatcgccgatggtggtgggttataagatgaaacctttaacctattggttagcaaaaagattggtaaaaacagattacatctctttgccaaatttattggcaaacgaaccgcttgtcccagaacttattcaagcggattgttcccctgaaaatttagcaaaacatttgagtatttatttatctcaaatgcctgaagatgtggctcggaagaatgcgttgaaacagcgttttatggaattacatcaatatattcaatgtgatgctgatgctcaagctgcacaggctgtggttgatgtcttgaatagagagtaaaaacgggcgatttttgcccgttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgcccgttttatacaaaatcaataatcaacaagtgattgttgatccgcaccctctttctctactacaggctgaatcatatgctcacgtttcaagcctaattcaagagcaacacctaccgccacataaatagacgagtaagtaccgaaagcgataccgatcaataatgccagtgagaagctatgtaatgttggaccacctaatagataaagtgagaataccacaaatagcgttgtaacagaggtcatcaatgttcttgataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaagtgaaatatccacaatttcgactgaatttgctcggcgaattttagggaaattttcacgaacacggtcaaataccacgatactgtcgtttaaagaataaccaacaacggataaaatcgcagccacgaaagtaagatcaatttcaatctgtaagaatgagaaaagaccaatagtcaccattacgtcgtggaacaaggctaaaatcccccctgttgctaaacgccattcaaagcgaaggccaacgtaaatcagcaacattgcaagggttgctaatgtgccgtaaatcgccccttgggttaattcttcaccgacatttggaccaacgaactcaatactttgaattttagcttctggatctaatttttggtgaattaaatccattaccgtattccccaaagacatatcgccagccgaagcaggtaggcggatcattacatctttttgtccaccaaaggtttgaactaaagcactggtataaccattttctgttaatacttcacgaacctttgccaaatctgcaggctgtgaaaagttggtttcaattactgtaccgccagtaaaatccaatccccagttaaaccctttagtcacaatggtaaacacacaaagtgccgtaatgatcaatgaaaatacatacgcaatgtagcggtatttcataaagggaactaatttataaggtagtttaatctctacttctttttctgttgtttgaacagtcatttaattccccttagatccaaagttttttcacacgtttaccaccgtaaacaaggttcactaacatacgagttcctgtaattgcggtgaacattgagatcattacccctagtgcaagagtcacagcgaagcctttgactggacctgttcctactgcataaagaataatcgcaactaatattgtggttaagttagagtcgaagatactggtgaatgcaccattatagccttcgtgaattgcctgctgaatagaacgaccattacgaatttcttctttaatccgttcataaatcaatacgttagcatcaattgacatacctacagctaacacaatccctgcaataccaggcattgttaatgtagctccaattaatgacatcaacccgatggttaaaactaaattagctaataaagcagctgtcgcaaatagaccgaagactttgtaatacaccacgcagaataagatcgttagacctaaacctaacatacttgcgtccataccttgagcaacgttatctgcacctaatgaagccccgatagttcgttcttcaacaatcacaatcggtgcgatcaaagctccagaacgtagtaatacagcaaggttttgtgcttcagccgcactgttaatacctgtaatttggaatgagctacctaaacgagagttaatggttgcaacgttaatcacttcttcgtgtttttcaagaatcactttcccgtttgcatcacggcgacctgaatctttaaactcactataaagggttgccatcggcttacctacagcagattttgtcgcatttgacatcaaatccccgccttgtgcatcaagattaatactaacattaggcaaaccacgttcatctttgcccgaagttgcattaataatatgctcaccacctaaaatggttttgcgatataacaccgtcggcataccatcacgactatatttaatctccgaatctgcaggaacaataccacgagccgcagactctaagttagcattaccattgactaaacgaaattcaagagttgcagttgcccctaaaatctctttcgcacgagcggtatcttgcacacctggaagttcaacaacaatacgatctgccccttgacgttgaatagtcggctcagacacaccaagttcttccacacgcttacgcaaaatcgacaagttttgttcgatagctaaatcacgagaagttgctaacccctgagcagattgagcaaaacgcacaacggttggagaaatataagttgcttctaaattaggattagtacggcgaatataacgaactgctttatctgcagtatcggtatcattaaattctacatctgttgcaaaattttctgcttttttaaccgctttgtattgccatttttccttacgaaaatcgttacgcaaggtatcttgtagctgatcttgctgtttcgccaatgccgtattcatatccacttccattaagaagcgaacaccgccacgcaaatccaaaccacgcttcatcggctcaccaccgattgaagttagccattctggcgttgcaggcgcaaggtttaaagcgacagaataattattgcctaagacttcagcgattttttccttagctggaagctgttcctcgtccttatttaaacgcactaaaatcgaaccattttcaaggttcatcgccttaggcgtaatatttaatgaagcgagtgctgattgaacttgcgtcagcgtttcagctgaagcttgttgccctctagtaccggaaacctgtaccgaagggtcttcaccatataaatttggaagggcgtataaaatgccaatggcgaccacaaggatcaccattaggttcttccaaagagggaaacggtttaacacgataagtcccctttcttaaaggaaaaaattaaagagatttgagtgaaccttttggtaacactgcaactacgaaatcacgtttgatagttacttcggtagtatcgttcaatgcgatcacaacattgtcattatctgcagttactttagtaattttaccgattaacccaccgcttgttagcacttcatcaccttttgataaacctgctaataattcacgttgttgtttttgacgttttgcttgtggacgataaatcataaaatagaagataagaccgaaaacaaccaaaataaagatcatttccattccgccgccttgttgcatataaagctcctttaaaattattaactaaatttagacttcatctcaacattgagataatcactcactaaaataacataaaatctaccgtttaacgagtggaaattcagacaaatctgctgatcggctttgtttctgttaagttttaggataatctcacaaagtattgtgtcaaatcattgaaattcaatcttaacaaggaaaaaagatgaaaaaaatcgtattacaagcggcagtatcttgcctatttcttacaaatgttgctttcgcccataatgtacaattaaaccaaacgttaccaagtgttaccgtgcaacaagatggcgaattaattgccaatggtaaaaaagttgattatcgccaatggcaatcttcaagcctagctggaaaggtgagagtagttcaccaccttgctggcagaagtagtgtaaaagagaaaaatcaaccattaatggacgcaattaaaaatgcagggtttgatcgcagtaaataccaaaccacaaccattattaatgcagacgatgcgattgttgcaacgggagcatttgtcaaaaatagtgcagaaaacggtaaattggaaaaccctcactctcaagtcattcttgatcaaacaagtagtgtaaaaaatgcgtggaaactgaaagagaaagagagctttattgcggtattggataaaaacggtaaagttcagtttgttgctgaggggaaattatctgatactcaaaaccaacaaattattgaattagtgaacagattaatttcccagtgatagataattccacaaatggagaaaaatggtgcaaatcgcttctagtgttacactacaagcgatttgttatttcaattattttacgatttattttgtatccaattgtgggatcacattattctgaacagaaagcaaacctgcctgtgtataaatacctaatttaccacgcgtatccacaatgtctaaattacgcattgttaattgaccaatacgatctgctggggtaaacggtgcatcttctactttttccatacttaaacgttctggttcataggttaagtttggtgattcggtattcagaattgagtaatcattgccacgacgtaattctaaagtcactgtgcccgtaatcgctttcgccacccaacgttgtgctgtttcacgcaacattaaggcttgcggatcgaaccagcgaccttgatagagcaagcgacctaaacgtaacccattgatacggtactgttcaatcgtatcttcgttgtgaatacctgttactaaacgctcataggcaatatgtaataacgccattcctggtgcttcatagataccacgagattttgcttcgataatacggttttcgatttggtctgacattcctaaaccgtgacgaccaccaatgcggtttgcttcaagaataagctctactgcatcttcgatacgtttaccatttaatgcaacaggcacaccttcttcaaaggtcacagaaacgacttcaggcttgatttcaaccgtttcgtcccaaaatgctacgcccataataggtttaacgattttaatgcctgtgctaagtaactcaaggtctttagcttcgtgagttgcccctagcatattagagtcagttgaatatgctttttcaacggacattttatagtcaaagccatttgtaattaagaattgtgacatttctaaacggccaccaagttcgtcaataaaagtctgatctaaccacggcttatagattttgagttttggattagttaataaaccataacggtaaaaacgttcaatatcattgcctttaaaggtcgagccatctccccaaatattaacatcatcttctttcattgcagcaacaagcattgtccctgttacagcacgaccaagcggagtggtattaaaataaggcacgccacctgtcgaaatatggaatgcaccacattgaattgctgcaataccttcgtgagctaattgctggcgacaatcaattaaacgagcattctccgcaccgtattccattgcttttctagggatagcattgtaatcatcttcatctggttgccctaaatttgcggtataagcataaggcacggcacctttttgacgcatccaaagtaatgcggcactggtatctaatccgcccgaaaatgcaattcccactttttgaccaagtggaagcgtttctaaaattgttgctgacataaaacttcctaatattttttgaatgaaattaaaaaattctcgcaatcttaccgcttgcgttcaaagttcgatattctaacgcaaaagtgaaacacaatctattcaaagaaaaagaatttataggtcacaaaaaaacggtaagatgtattatcttaccgcctgtaaaatgcattatattaactagttaaattataaatagaatttctcaacaaagtttaatttgtcatcaagtttcaacactaacggctgaccggttgggatttcaaaatccataatttcttcatcagaaataccgatgatatgttttgccaacgcacggagagagttaccgtgagcagtcacaagaacacgtttaccagataacaatgccggtgcgatttggtcttcccagaatggtaaaacacgctctagggtgatttttaggttctctgcatttggcacaacatcttttggaagatgtgcataacgacggtcgttatgtgctgaatttggatcttgcggatctaaatctggcggagaaatatcataagaacgacgccaaatatgaacttgctcgtcaccatactgttctgcggttgcttttttgtctaagccttgtaatgcgccatagtgacgctcgtttaaacgccagtttttcacttgtggaatccaaagttggttagattcttctaacacgatgttacaggttttgatcgcacgcgttaaaacagaagtgaatgcgatatcaaattcataacctgcatcaagtaattttttacctgccgcttttgcttcttcaataccacgctctgttaagtttacatcacgccaacctgtaaataagtttttagcgttccactcactgaaaccgtgacgaataaatactaattccataagttctcctatataaaataaattgatttaatgtctatttataacaaaaaatactttttttttaaagttaaacacaattaatttgaagataaaaatgatctatgacaaaaaataagatgtaataatttattcctatgttggtaagaatgctactatttgcttattgcgagcatagggtatttaaaatctgtctcacccgctccaaatcctccgccgtatctaccccaacttgaggggcttctttggctaaatcgagatgaattttctcgccataccataatgctctaagttgctctagcgactctagctgttctaatgccgttggctcccaagccacatattgcttaacaaaacctgcacggtaagcatagattccgatatgacgaaggtagttttgttgttgaacaaaagcatcgtcacattgagggaaataatcacgtccaaaagggattgttgcacgagagaaatagagtgccattccgtttttatccgttaatgttttaaccacatttggattaaatagctcttctcgtgttgtcaatttaaccgcaagggttgccatattaacttgatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatctaaattttcagccacttgtgccacaatcacaggcggaataagtggttcatcgccttgaatattcacgataatttcatcatctgcaatcgccattttttcaatcacttcggctaaacgttctgtgccagaattatgtttatctgacgtcaagcacacttctcctccaaaccttgtaacagcctgttcgatttcggggtgatcggtcgcgacgattacacgagtggctccagcttgttgtgccttttcccaaacgtgttggatcatcggtttacctgcaatatctaacagaggcttacgcggtaaacgtgtagaggaataacgagcggggataatgacggtaaaactcataaaatctcctaaatgcgactaagatcaaatttcgctaaatcaatatgatttggcgtgccataaaattcacacaaggcttggcgaagttgttctgcacgtttgggtaagcctttttctgcatagattttaacttgttcataaacggcttgtttgaaagcagaattatcaccagcatcgcccgttaagttatcagcactggcaaaataacggaaatttgctgccgtagctaacacccattcaatcgcttgcggttttacttcgacttgttcaaattctctttggcgttcagcagagcgtccatcaggttcataccagtagccaaagtcttctaatttacggcgttctgttcctgcaactaaccagtgagcaatttcgtgtaatgcactgctgtagtagccgtgagcaaataaaataacattataagggcgttcactcgctacgttaccttcatcaataaaagcggggagataaatcggataatctccgccccgctctaaacgagtgttgtaattttctacaaagcaagcgtcaaagatacgaataagatcttcataatcgtgatcgttttggttcattgtaaatcctatttgagataacttacaaaatcagtaatttcttctgttttgctagcggtggcaatgctatccccctcaagtggcgagccaaccagcagtaatgcaacaatttcatcgtcagcttgacaaccaaaggcctggcgtaaagcctgtcctttaatccacttattggtaatccagcaagtttcaaagccttgaacgttggctgcaagttgcattgcataggttgcacagcctgctgtaaccatttgctcccaagcgggtactttgggtaaatcttttgctattttagcgataatcccgataaccattggggcgcgtttagctaatttttctgcttttgtaacaccttcatcacccatttcaagttcttgagcggtttctaacaggcaacgacggaaagtttccattgccgttggctcaatcactacgaaatgatagggctttaaacgcccgtgatctggcgctctaactgccgctttaaacatattttctagttgttctgcatttggtacatcttgaccaaattttttacttgaacggcgacgttgtagtaaatctaacgtttccattgagtatttctcgtgataaaaaatgggttaaaggatagcatattttgttaagtttcgctttgttttgttgattgtagggaaaaaggaggattggctatttatttaaaaataattttttagatttagcgatcctaaaattgtttgctgtacactagcagtttgagcacattattgtatagcttcatattgagcttcaaatatcgtaaacgtttgcttaagatccaattttcattatttgatcttgatcacattttttatgtgagattttccgcaagttattctaaaaatagtgtaaacttatcaagtttttcaggtgatgatatagggtgattttaatcatcgattagtcgtctaaacactattcatttttatattgattaattttaggagtcgaaaatggcagaacgtagagaacttgcaaatgctatccgttttttaagtatggacgcagtgcaaaaagcaaattcaggtcaccctggtgcgccaatgggtatggcggatactgcggaagtgttatggcgtgattttttatcacacaacccaaccaatccagcttgggcaaaccgtgaccgcttcatactttctaacggacacggctcaatgttgatttatagccttttacatttaacaggctacgatctttcaattgaagatttaaaacagtttcgtcaattacactctaaaacaccaggccacccagaatatggctattcaccaggcgttgaaaccacaacaggtccgttaggtcaagggattactaatgcagtaggtatggcgattgcggaaaaaaccttagcggcacagtttaaccgtgaaggtcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagattgtaaatcactacacctatgcgttcttaggtgacggctgtttaatggaggggatctcacacgaggcttgctcattagcaggaactttaggcttagggaaattaattgctttctacgatgacaacaatatttcgattgatggtcacgttgatggctggttctctgacgatactgcaatgcgttttgagtcttacggttggcaagttatccgcaatgttgatggacacaatgcggaacaaattaaatttgcaattgaaaatgcacaagcagaaaaagatcgcccaaccttaattatctgtaaaaccattatcggttatggctcaccaaacaaatgtaactcgcacgattgtcacggtgcgccattaggtgatgcagaaattgcggctgctcgtgaatacttaaaatgggaacacgcaccttttgttattccagctgaaatctatgcagaatgggacgcaaaagcaaaaggcttgctcgcagagaaagagtggaatgcaaaatttgcagcttatgcaaccgcttacccagagcttgccgctgaatttaaacgccgtgttacaggtgaattaccagcaaactgggcgaaagaatcacaagcgtttattgaaaaattacaagcgaacccggcaaacattgcaagccgtaaagcatcacaaaatgcgattgaagcctatgcacacattcttcctgaatttttaggcggctcggcagacttagcgagttcaaacttaacattatggtctggctcaaaaccaatccgtgcagatcataatgttgatggtaactacatcaactacggtgtgcgtgagtttggcatgtcagcgattatgaacggtattgctttacacggtggctttattccatacggtgcaaccttcttaatgtttatggaatatgcacacaatgcggtgcgtatggcggcattaatgaaacaacgttcattatttgtttacacccacgattctatcggcttaggtgaagatggcccaactcaccaaccagttgaacaaactgcggcattacgtttaattccaaatcttcaaacgtggcgaccgtgtgaccaagtggaatctgcggtggcatggaaagcggctgttgaacgtaaagatggcccaagtgcattaattttcactcgtcaaaacctagctcaaatggaacgtaccccagaacaacttgccaacgtggctcgcggtggttatatcctacgtcaatgctgtgaaaaaggcgattgcccagatttaatcttaattgcaacaggttcagaagttgaattagcgatgaaagcagctgaggtattaagtgcagaagggcataaagttcgtgtggtttcaatgccaagcactaacgtgtttgacgcacaagatgaagcttatcgtgaatcggtattaccaagctcagtgaccaaacgtgtggcgattgaagcaggtatttcagatttctggtataaatatgttggctttggcggccgcattgttggtatgaatagcttcggagagtcggcaccagcaagtgaattattcaaactcttcggctttaccgtagataacgtggtagcgaaggcgaaagagattttgtaattacatagaatgtggcaaaataaggggattttatatccccttattttttagtttctatttgggaaatcagaaaatgaataaaattcttgttattcgtaacgataaaattggcgattttatgttggcttgggcggcatttgcgatgttaaaaaaatcaatgccgaattgccaaattattgcccttgttcctaaatatacagcaccattagcggaaatctgcccttatttagatggtattattttggatagttcagataaacaaaataaagctgaaaatgatcgtgtattacaagcggtaagatctgagcaatttgatgcagtgattagttttgtgtcggattggtataacgccaaattggtttggaaaagccgtattgtctaccgtttagcacccgcaacgaaactctttcaatttttatataatcaccgtttaacccagcgtcgctctcgttctgaaaaagcagagtatgaatataatgtagacttagtgcgttattttttgaaagataatcaaattacagcggtagagccgacgacaccttacttatcttttgataatgcttgtctgagtacgcaaaaaagcaaattaatggaactattaaagttagatggcaataaaaaatggctttttgtacatagtagtacaggaggatctgcgacgaatttatctttgaatcaatatgcggagttaattttagggattttagcgaaatttgattgccaagtgattttaaccgcagggccgaatgaaagcgaaactgctaaagcattgcaacaattagtaaatcataagaatgtggttatttatgataaaaatgatggattagtcgattttgccagatcgttagcctgtgctgatctctttattgcaggttcgacagggcctttacacatttgtggggcattaaatattacaacggtaggtttttacccaagtcgtttatctgccattccacgccgttggaagccgttaaatgatgccgataaacatatcgcattttgtccgccatctgataaggcttcgcaaaaaaatttaaccttaattccgatggataaagcattaacggagattctgccgtttatgagacaaatcatggataataaaaaattataggatagtaagtagtaatatgttttagttattactagtaattaaatgttattaatatagtattttttattgttacaatctatctacttttgaattagagaggctacatgcaaaaaagaatttttaattttatccagaaaaaatatttatgtactataagttgtgcaaagaataatattccttggtctaatgcattttattatgtatttgatgaagataatctgcgtttaatttttgtgacgagtttaacgacttatcatagtcaagtgatgttagagaatcctaatatttctggtacaatctttgtaccaacgcgttttcatccctctttacaaggtgttcaatttacaggtaaagcaagaaaattagagggggatgaaaaaaatattgctagagaattatataaaaaagaatattcacatgaacttattgataaattgtctatttgggaggcaaaattagagtatgctagattaattgataattcattaggattatttagtgtaatagaatggaatggggaagaatatttctaatatatagttttatactttcaacatcatagattcttttgagaaataaatttattagaacataacagtatgaatataaaaattcttattactggtggtgcaggttttattggatctgcaatgattaggtatattattaataatactcaagacttagtaattaatatagataaattaacttatgcaggtaatttaagctcattagaggagatttctaatagttctcgttatgcatttaaacaaatagatatttgcgataaaatagccttagagcagatatttaatgaatatcagccagacatagtaatgcatttagctgcagaaagccatgtagatcgttctattaagaattcggaagtatttattaagactaatatttggggaacttatactttattagaagtagctcgtaaatattggaatgatttgccagaggaaaaaaaatctatatttcgtttccatcatatttctactgacgaggtttatggtgatttaggaacaagtgagaggcagtttacagaaatcatgccttatgctccttctaacccctattcggcatcaaaagccgcaagcgatcatttagtgcatgcttggaggcgtacttatggggtaccaactatcgtcacaaattgctcaaataattatggtccctttcattttcctgaaaaattgattccattgatcatcttgaatgcaatagaaggaaagaaattaccaatctatggtaatgggttacaagttcgtgattggttatttgttgaagatcatgtgagagctttatataaggtaattaaagaaggtagagtgggagaaagttataatattggtggtgatagtacgaaaagtaatctggaggtggtttatgctatttgtgaaatattagaagaattacttccacataagccaaaaggggtacagaaatataaagatctaatttcttatgtaccggatcgtctagggcatgatactcgttatgctattgattcaactaaaattcgcgaagaattagattggaaacctcaagaaacttttgaaagtggaattcgtaagacagtagagtggtatttaaataatcaaaaatggtggaaaagcataagaaaaaataatttttcgtattcttgttaaacaaaatagatattcattccttagcaacattctgaatgattaaacttaagaatacctttggttattttatcgctgtagagtgaatttgctaattactattttaacaaaagttattgaattttatcttctttcaaatacttatgttataaatgagtaagcctatctattagtggatcttcaaatataaaccctgcagattgtaatttgtgaggcacaagcggttgattatctaataacaattgcgaacgttcacctaataaccattttaagatccattcaggcacagtaaaaaaggctggacgtttaaggtgttgagccaatttttgattgagggcagaattagtcagtagatttggcgacaccaaattaaaagcaccactacattcgaaatgattgagtagaaataaaattgcccgaatttcatcatttagcgaaatccaagcccagtgctgtttaccggatcctagctttccccctaaaccgaaacgatagagcggcaacattttttgtaatgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcctgttttgtctaatacaatgcctgtgcggataagacaaactctcgttttatcactttgagcttgtaaagcggtcttttcccactgaaaacagagctgggctggaaaagctgtaccacaagcggtctgttcatcgtaatgttttccttccgccaaattgccataaaaacctgttgccgatcccgaaataaaagtgtgtgggggcgtgtcgctcgcttgaattagttcgactaaacgctgggttatgctaagacgactttgtattaatttttgtttctgtgttgtagtccaagctttgttaaaaatcggctcgccagcaagattgatcaccgcatcgaatgtatttaaatgctggaaagcggtaagatcttggcaaaaacttaccgcttgttgatgaggtagcctttggcgagtcagtacggttagctgatgtccttgcttgattaaagcctgacaaagtacttttccaataaagcctgttccgccagtaatcagtatattcattagagtgagctatcaaaaagttctgtaatagttgcaatcaatgttgaaatagaggtatcacgagttggggtaatgaaaatcgtatcatcgcctgcgatagtcccaagtatgccttctgcttttcccattgagtccagtaatcgagcgatcaactgtgcggcaccaggacttgtacgaacaacaatcaaactttcattatggtcgatatcgatcactaaatttcttagtgggcttgacgtggttggaataccgagttctgctggtaagtgataaaccatttccatttttgtatttcgggtgcggactgccccaaatttactcaacattcgggatacttttgattgattgatatgctcgaatcccatttcttgcaacgcagtgacaatttcgctttgtgaaccaaatttttcttctcgtaacaatgatttaaaagcttcgttgagagagtcgagtttttccacttattatccttttatttttatgcaattgtagccgtaaatatgcagaattgttgcctatttattcacggaaatcaatctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggaaatcaatctaaactcactttttttctcgaaaatttgcggtaagtcgcaaaattgtattttggtatttgaaagttactatgaatttacatacactttcgctattaaatttacataacctatgaggagaaacttatgaaagttgcagtattaggcgcagcaggcggtatcggtcaagcattagctttattattaaagttacaacttccggctggcacaaacctcgcactttatgatattgcccctgttaccccaggtgttgcagttgatgtgagccatattccaacagccgtaaaagtggctggctatgcaggcgaagatccaacaccagctttagaaggagcaaatttagttttaatttctgcgggtgtggctcgtaaaccaggtatggatcgttctgatctattcaatattaatgcaggtattgttcgtaacttaattgaaaaagtcgcaacagtttgcccaactgcttgcgtagggattattactaacccagtaaataccactgttgctatcgccgcagaagtcttgaaaaaagcaggcgtttacgataaacgtaaattattcggcgttacatcactcgatgtattacgttcagaaacctttgtagctgaattaaaaggtaaagatgtcaatgatgttaaagtgcctgttattggcggtcactcaggtgtaaccattctgcctttactatctcaagcttctgaagaagataaaattgacttcaccgcagaagaagtggcagcattaaccaaacgtattcaaaatgcaggtacggaagtggtagaagctaaagcaggtggcggatccgcgactttatctatggctcaagcagctgctcgttttgcgcgtgcagtgttaaaaggcttaactggtgaacacgttgttgaatatgcttatgttgaaggcaatggcgagtatgctcgtttcttcgcacaaccagttcgtttaggcttaaatggtgtcgaagagttgttacctatcggtactttaagtgcttatgaggaagaggctgttcaagcgatgatcccaaccttaaaagcagatattgagttaggcgaaaaatttgtaaacggttagtcttgaatttatcgtaaaatcacgccatgatacaagggctggaaacttcagttttcagcctttttatatactactatggtgtactaatatggattatcttattaacgtcaataacactaattttagtgaagttattaaagctgcagcggaagtccctgtcgtttttcattttatttcttcccgtgagcctcgttcacttgagatggaggcttgttttcgtcgtttaaacgatgaatattcaaaacaatttctccttgctatcgtcaactgtgatgaatacccgatgattgccgcacaatttcgcatacaagcggtgcctacaagttatttctttgcaaatgggcaacctgttgatgtgattgagggtgagataaatgaacaagaattgcgagttcgtctaagcaacattttacccaaagaggaagaacttcaattcgctcaggcacttgaatttctagaagcagaacagtatgaacttgcgttaccgttattaaaaaatgcttgggaactgacgcataagaaaaacagtgattttgcgttactctatgcggaaacctatattacaatgaagcaagttgaaccagctaaagcaatcttaatgcaaattccaattcaagatagagatagccgttggcaaggtttgcaagatcaaattctattactagaacaagcggctaattccccagaaattcaacaactccaagctgattatactaagactaaaagtcctgagattgccgtaaaattggcaaatcagttacatcaagttggtaggaatgaagaagctctagaattattatatgattggttgaaacatgacctttcagcaggtaatggagaaattaaaaagcaatttctcgctattttatctgcaatggggaatgtcgctcctcttgttcctaaatatcgcagacaactttactctttattgtattagttttagtaagtgatttttcatatatttaggagaacaaaatggcaacaaaacacgcaaaattattgattttaggttctggccctgctggttacacagcggcagtttatgcggctcgtgcaaatttaaacccagtattagtaacgggaatgcaacagggcggacagctcactacaactacagagattgaaaactggcctggggaatttggcgatattacaggttcagagttgatgaacaaaatgcaaaagcacgctgagaagttcaacactgaaattatttttgaccatatcaacagcgtcgatctttcacaacgcccattcaccttaaaaggcgactttaatacctttacctgtgatgcgttaattatcgctacaggtgcatcagcgaaatacttaggcttgccttctgaagaggcttataaaggtcgaggcgtttcggcttgtgcaacctgtgatggtttcttttatcgtaataagccagtagcagtaattggcggcggaaatacggctgtggaagaagcgttatatctttcaaatgtagcctctgtggtacatctagtccatcgccgtgatacttttcgcagtgaaaagattttaattgaccgcttgatgaaaaaagtcgaagaaggcaaggtgattttgcacacccacagtgttttagatgaagtgttaggcgataatatgggcgtaactggagtgcgtttaaaatgtactcaaacaggtaatgaagaacagattacgcttgacggcgtatttgtcgcgatcgggcattcaccaaatacggaaatttttaaagatcaactagagcttaacaatggttatattgtggttaagtcaggtttagatggcaatgcaaccgcaacaagcgttgcaggtgtattcgccgctggtgatgtgatggatcataactaccgccaagcgattacttcagctggaacaggctgtatggcagcgcttgatgcggagcattttttggaatattgctcataacttttgatatagtagacaaaatagttgctaatgtttgttttctttaaatattagcaaccttgtctattacatctagatcgtttgttcccagtattttcctcattgtagggagcaatatttcagtcacaattatttgttgtgctcaattttattaagataagaatatgtgttaagaggcagaaaagtaaagtgggtagaatccttcagatgattatttctgatatttattccacaaatcagcatacttcacaaaagtagaatgtgccgacagaacggcaagtaaaaaaccttgcttaccatcaagaaaacctgcttttaaaatatacatttttacaaaacagccgacagcgtgggtaacaccttggaataaagttgcttttttgccagctttggctctttgctctgaccaagccttagcgtaacttgctgattttactagataatggtgaatatctttataagtaaaatgcaataaatcgcctttaagtttagcgactttggcttcttttggataatggactttttcgtgaacaagttcatcgccgtattgagcaaaatccgtacggtaaagtctcactacataatcaggataccaccctgaatggcgaatttgcctgccaaaaacttcacttaaacggggaatttgataaaccgtgttaggttcattactacttaccgcttgttgtatgctctgttttaattctggggtgacacgttcgtcggcatccagccagaggacgtaatcgctggtgacatattgttgagcgagttggcgttgtttaccaaaaccttgccaatcggtattttcatagaattttgctccgtattgtaaggcgatttctttggtattgtcgctacttccagagtctagaatgatgatttcatccacccaacctttgacagtttctaaacattgggcaagatcttgcgattcgtttttgacgatcattgcgacgctaatcgttggcataggttatcctttttgaaattaagtcagtttcgcctattttagcatatctttagctttaaaatttattctgaatatgctattttctacgccgatttttttagcatagaaaggcaattttaatgtcagtaaatttaacaacaaaacagaaacaatttttaaaagggcttgctcatcatttaagcccagtcgtgatgcttggtggtaatggtttaaccgaaggggtgttagccgagatcgagaatgctttagatcaccacgagttgattaaagtgaagatcgcaggggctgatcgtgagatgaagcagttgattattgatgcgattgtgcgtgaaaccaaagcggtggaagtgcagaccattgggcatattttagtgctttatcgtcaaagtgaagagaagaaaatcagcttgccaaagatagctaggagcatttaatcaaatcttcaggaatagatgtttgtaagcacagtgatatattcatagggacagagaaattagttaatacttagagtgttgtatgaataataaacaaaatataagcctgttactcaaacaaaattttgcatcaggattagtcgtttttcttgtcgcattgcctttgtgcttaggtattgcccttgcatcaggagcgccacctttagctgagattttatctggggttattggatgtgtcatcgttggcgcattaagttcttctcatattagtgtttctggacctgcagtgggtttagcagcgatgacagaattggggtctttcgagttatttttatgttctggtgtgattgcgggcgcactgcaattgcttctgggttttcttcgagctgggagtatctcaaactatatacctatttctgtgattgaaggaatgctggcagggatcggtgtgattattatccttaaacagttaccttatgcccttggtagtgatgatacattaattgaaattgttcattctactggacgggttcatttagggtctttggttgttgcagtagttgcgtttattattatgattggttgggaagagcaacctcgattacgttaactcaaattactcccttctgctttagttgccgttattgtggggattttacttaaccagcttttcatatggttcaacagctcgcttgcaattccaacaaatcaattagttcaactaccactattaaactctttagatgaagtcagttccttaattcgctttcctagcttagagggtttcaataatagcatagtctggattacagggggaactattgcagtagttgcctctgtggaaacattactttcaattgaggctgcagatcgtttagatgttcgccgtcgaattacggataataatcatgagttacgagtacaaggttttgctaatatattaacctcttcgataggaggtttacctatgacatcggtcattgtgcgttcttctgctaatgcaaatgcaggagcgacttataaaacatctgcggtatttcatggtgttttgttgcttatgtgtgtattaactattccaagtgtgctcaaccagattccccttgcaacgttagcggcagtattaatattgattggatataaattgacacatccaaagcattataaacctttttggtgtaaggggagttatcaatgtattcctttcgttgcaacaatggtttctgttgttttccttgatttgctgaaaggggtagggattggcttagtgattagtattctattcattctgcatggaaatatgaaaagagcttattacttgagctaggtgaagaagtctcttttttgaataaggcagcgattaagaaaactttaaaaaatattcaacctaattcaaaagttacaattaatgccaagcgggctttatatattgcaagtgatgtattggaattactagaggactttaccaatgtatatgctcaagaaaataatattcaggttaaattgcgtggttttaaatatgactatgaacatcaggaagggagagagcatacacatattcgagttgagcatcgaagccggatttagccataaaggagtgctagaggaaatatagaccttagttcttattttgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgttttctgtatacatatctgatttgattctccgcttttactttttttccaaaaaatgttaaattgatcacatttttaatccattgagataaccactgatgaaagagctgatcttacctaaaataagtcaaaacctagcaagctcatctctttttcaagatcaattatcttatataaaacatcgagttgatatgctcgatcagttccgtatccataatacgttacgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattccgaagctttccaaagcgttttttcattattacccgctttattacactataacattccgagtttgcctgcgtatgttgaaaatgcaccaaaaggtatttttaatttcaacttatcggctactcagaaagcccatttgtcgacctattttcctctgcctgaagatacaaaatatgtcgcttttgatggtttgtatgtgatggggagtattggatcaattacgcaaacttgtttatcagacttggatctatggctttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctctgcattagcgattgatgaatatttcggggcaagtctttggcaactttataaagggattgaaagtccttataagtctgcgattaaaattttattgttggaaagctatgcagaaacttaccctgaaacacaccttatttctaagaaattcaagcagttattgctttcaacagcagaagttagctatcattttgatccgtatttggctatgttagagcaagtaacaacatatttagaaaatcgtaaagagtttgttcgattagaccgcttgcgtagctgtttttatatcaaggcttatgatggtcagcacgatagctggcgtaaagaagcattgagagagttggtgacgcagtggcaatggagtgaacgtgaaatccaatgtttaaataattgccgtcagtggaaagtaaaaaaagcaatgacgcatcagcagatgattgttgaacagttattgcaaagttaccgtaatttaattcaatttgctcgcaaatttcatattgatcccagcattttgccacaggataccgacattttaatgcgtaaactctattccgcatttgaagtcgtaccaggtaaagtgcctttaatcaatcaaaatatcgctcgaaatttggctgaagatgaagtgactttcattgaagtcaatgaaggtgtttcaactaaagcaggctggtatctgatcaatcacgccccgttaagttcctatgactcaacaacccgtcacgttcagtatcaacgaacacttatcaaatcagtggcttgggcttattttaatcgagttattacagcctctacgcaaattcacttggtcagccaaagcctccagctttcaaccttacgtcaatttattacagatttacgcctttcatttcctgtcgcaacgccagcattgaaagatgatgatctttatcacccaaatgaaattcgtaacctgattgtcgcgattaatttaattcaagatcccacaaaagctctcccttccttgtctaaaatggagatggcacaactggatctgtttaatttaggctcttcagagcaaggaatgattggtagtgttagcattatttatcgcaatatgtggaatgaaataatgacacagcactttgagggaaatgatgccattttgaaatccctcaagttaatttctaataaaatttatcgtaattctgcacctccacaatctgtcaatgtattttgttatagctgtcagctaagaaatgagttacaaaatgcagtaatgagtttggtcaatcgttgcattaccgtacaaacaggctctattttccaacgccagcaggcacagacattcaaaatggctggaaaaaaatggcaactgatttttaataaaaataataatttacaaaatattgttgccgatgaactcaacgatttgggtgatgagttgtcagagtttacaggcaatattcctaaagagatttatgattttgccagcgaaggctttttacaatttttctttgatgataacgccgacggtagttttaatgtttatgtccttgataaaaataaccagaccgaatgttattgcaactgtgttggggataaagaaaataaaatccgacgtattagccgatcttattcagacacggaaggtaccaaagaaagccttaatagctttaattttcctcagttttatcagctattaaaacaaaatgatatgattaaaattgtaccatttcagagtaaacaacatcgagaatttttagaacaacattaaaaataggaaagtttgtgtcctcaactttagctaaccccgaattgattaaaaccgtggtgttacttgcaacaagtattaccattgttccgctttttaaacgaattggactgggcagtgtattaggttacctcgtggcaggttgcttaattggaccttcaggtgcgggactattccaagatccaaatgcagttgtacatatggctgagcttggggtagtgatgttcttgtttattatcggcttggaaatgcaccctgagcgtttgtggagtatgcgtaaagcgattttcggtcgaggttttttacaggtcgctctatgtgggacattgctcacttttgcaggtatttttattctaggtttaccaaaagaagttgcgttcattgcaggaatgggctttacactctcttcgactgcgattgtaatgcaagtgcttgaagaaaaagggattagtaccacacctaaaggacagcgtatcgtttcgacattaatttttgaagatctagctattgtgccactattagcctctattgcatttttagcacctgaacaagctggagcagagcaagggacaaattggactgcgattggtgcgggcttagtgggagtgctgatcttagttgcttcaggtaaatggttaatgaacccactgtttaagatgatttctaaagctcacattcgcgaaatgatgaccgcagcggcattattagtggtattaggttctgctttgttaatggaattgagtggtttatctatggcaatgggggcattcgttgcaggggttatgttgtctgaatcgtcgttccgtcatcagctagaggcagatattgaaccatttaggggtttattacttggtctattctttatgggcgtgggaatgtccctcgatctttctctcgtactaaataattggttatggttactgggtgtgatattactttatgtggtaggcaaagggttatctatttatgttgttgcattagtcacaaaattaactaaccttgaagctattatgcgtacagcgattatgtcgcacggcggtgagtttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccttttttctgctgccgctaccgcaggtgtttttacagcagataatcaagcgactttcacagcagcagtgattgtatcaatgcttttatctccattggtgatgatcgtcattcaacgtttagtgaatttgaaagtgaaaaaatccacaggagaagctcagccaaatttagagggcattgaatttgcagaaaatttagaaagtagtgttcttgttattggctttggacgttttagccaaatcatctgtcaagtattgttagctcgcagaattaatgtttcggtgattgattctgatgttgagaatatccgtatggcaacccgtttcggctttaaggtttactatggtgatggagcaagaattgacgtattaagagccagtggtatagcacaagcagactgtgtgattgttggtttagctgaacctgatcgcactttgcaaatattagaattaattaaacacgaatatccattagtgcctgtttttgctcgttcttacgaccgattcaatactgtgaatttaattaaacatcatgttgattaccaagtgcgtgaaaccttcgaatctgctttattgctgagcaaggtgacccttgaacgattaggtgcaacagaaacagaagctcaagatgtaattaatcttgttcgccatttagatcaggagcgtttgaacgaagaagtactacacggtttttccgatgaaattgcgaaaaaatattggcgagttgaacccttcgtaaaaccagcacacgaagcgacagctttaaatgaagaaactgcagatattttagaagaaattggcgaaagtattgaggtggttgaagttgaacttgatgatcagagtgaaatggaaaagattaagttcgcgactgatgaaaagaaagaagatgaattaagttaaaacaatttttagctatttgaaagttaaattactttataatttaactttaatatgaaatgtaagatagattaagacaatgattgaagctgacagaattatcagtgcctcagcaaagaaagaggacgaaactatagatcgtgcaattcgccctaaaatgcttgccgattatgtcggacagccgtcagtgcgagagcagatggaaatttttatcaaggcggctaaattacgcaatgatgctttagatcacctgttgatctttgggccaccaggcttaggtaaaacgacactggcgaacattattgcaaacgaaatgggcgtgaatatccgcacgacatcagggccagtgctggaaaaagcaggggatcttgccgcaatgctgacaaacctagaaccctacgatgtgctttttattgacgaaattcaccgcttgtcgccagccattgaggaagtgttgtatccagcaatggaagattatcagcttgatattatgattggtgaaggccctgccgcacgttctattaaactcgatctccccccatttacgctcgttggggcaacaacgagagcgggctctttaacttcgcctttgcgtgatcgttttggtattgtgcaacgccttgagttttattccgttgaagatctcacctccattgttagccgtagtgccagctgtttaaacttaaatcttgccactaatgccgcttatgaaattgcacgccgttcacgcggaacgcctcgtattgcaaaccgcttgttacgcagagtacgagattttgcagacgtacgaaacaacggcattatttcctctaacattgcaaaacaagcattaacgatgttagatgtcgattccgaaggctttgattttatggatagaaaattactttctgctgtaattgagcgatttgatggcggacccgttggattagataaccttgcagccgccattggcgaggaacgggaaaccattgaagatgtgctagagccttatttaatccaacaaggctttttgcaacgtacaccaagagggcgaatagccacatcgaggacttatagtcatttggggttggtaaaatctgaatagtgtaaatcggtagaatttttaaggttctaccgattgttttttgttttatccattgattttctttactcaagtcacatttttacaaataatttctgtaaaagtaacttaaaaactttacaaaactaattttttaagttactaattaataatttttaacacaactaaaaacggagattatttatgcaaacaacctttacccgttctttattagccagtgcgattgcgcttggtctttctgtttcggcttttgcagctaaagtacctgaaggtacggtgcttgcagagaagcaagaaattattattaataacagctcagaaccatcaagttttgaccctcataaaacagaaggtgtgccagaagctcaggtttcttatcagttacttgaaggcttagttaccaaagattctgcaggtgaaatcattcctggtgtggctgaaacctggaaaagttctgaagatttcaaaacgtggacctttaatttacgcaaaaatgcaaaatggtctaacggtgaacctgtgactgctcacgattttgagttttcgcttaaacgtttaggcgatccaaaaaccgcttccccttattctagttatttaaactatcttcaagttgaaaatgcccaagagatcattgatggtaaaaaagcaccgagtgagttaggggttaaagctgttgatgattacactttagagatcaaattaagcaatccagtgccttatttagtcggtatgatgacgcaccaaacgatgttacctgtgccaaaagcggtcgttgagaagttaggtgatgcttgggtgaaaaaagagaactatgtgggtaacggcgcttataaattagtagaacacgttattaatgaaaaaatcgtgtttgaacgtaacccattgtattggaatgataaagaaaccgtgattaataaagcgacattcttagccattccaaatgcaagtaccgatgttcaacgttatcgtgctggcgatttacatattacaaaccatgaattaccgccagaacagttcccgacacttaagaaagaaattccaaatgaagtctttgtgacgcgtacgctttcaacctactactacgagccaaacaatgagaaagctccatttaatgatgtgcgtgtgcgtaaggcgttaaaccttgcattagatcgtaacgtgattacggataaggttttaggacaaggtcaaaccccaacctatgtgtttactccgccgtacattaccgaaggtcacttaattcaacaacctgagtattcaaaacaggatatggcatctcgtaaagcagaagcgattaagttgttagaagaagctggctttagcaaagcgaacccgcttaaatttacgcttttatataacactaacgagaaccataaaaaaattgcgattgcagcacagtcgatcttaaaacaaaacacaggcggtttagttgatattaaacttgaaaaccaagagtggaaaaccttcttagatacacgccgtgcaggtaactatgatgtggcgcgtgcaggttgggcggctgactataaccaagcatcgactttcggtaagtacttcttgtctaactcaagtaacaacaccgctcgttataagagcgcggcttatgatgctgaaatcaatgcggcataccaagcaggcaatgcggaagagcgtgcggcagcttatgcaaaagcagaagctcagttagcgaaagattatgcaatcattcctatttataactatgtaaacccacgtttagttaagccattcgtgaaaggttatgagggtaaagatccgcaagataatattttattaagaaacctttatatcattaagcagtaacttttaagcggtgcgattttttaaaatctttgcaaattttgccaaaaatcgctccgcttgttttcttttgttgtgcggatcggagaattgagcaatgttgaaatttataataaaaaggattttagaagcgattccaacgctttttattttaatcacattttcgttttttctaatgcggttagcaccaggtagcccatttacctctgagcgtgcttatccacctgaagtgatagcaaatattgaagccaaatatcacttaaatgaacccttatataaacagtattttatctaccttgagaacttagctcagggggattttggtccttcttttaaatataaagatcaaaccgttaatgatttaattgcttctgcttttcctgtttcatttaaactggggattgttgctttttgctttgcggtaactcttggcttgctggcaggaacggtggcagccttgaagcaaaatagtaggtgggactactttataatgtcctttgcgatgacggggattattatgccgagcttcgtctttgcccctcttttagtgttaatttttgccatttatctcaaatggctacccgctggcggttggaatggcggtcagctctattatatggtgttacctgttttatcgcttaccattgcctatgtcgcagggattgcgcgtattacgcgtggttcaatgattgaagtgctacattctaattttattcgtacggcacgagctaaaggcttgccgatgagtaaaatcatttttaaacacgctttacgcccagctatgttacctgtgattagctatcttgcccctgcgtttgtggggattattacaggatcaatggtgattgaaagtgtttttggtttacctggtatcggacagcttttcgtcaatggggcattaaaccgtgactattcccttgtgttaagtttaacgattttggtcggcacattaaccattttctttaatgcggtggttgatattctttatgctgtgattgacccgaaaattcgttattcataaggagtgtgagatgttaattaataataagaaaaatcaagaacttgcagaaaaattagtggaacagaccgctgacatcgccgtggaaggtcgcagtttatggcaagatgctcgtcgtcgctttttccgtaataaagcggcggtaagtagtctgatcattctcttttttgtggtgttattcatcacttttgcaccgatgttaatgccatttagctatgaagatacagattggaatatgatgagtgccgcccctgattttgcatcaggacattattttggtactgatgcttctggtcgtgacttgttggtacgaattgcaataggcggacgaatttcgctgatggttgggattgcaggggcattgattgccgttgtcattggcacaacctatggggcaatttcgggctatgtgggcggcaaagtcgatatggtgatgatgcgtttgctcgaaattttaggctcgttcccatttatgttctttgtgattttattggtgacattcttcggtcaaaacattctgttaattttcgtggcaatcggtatgattgcgtggttaagccttgctcgtatcgtgcgaggacaaaccctcagcttaaaaaacaaagagtttattgaagcggcgattgtctgcggtgtgccgaaacgccagatcatctggaaacacattattccgaatgtattaggtatcgtggtggtttacgcttcccttgaagtgcctgctttaattctatttgagtcctttttaagtttcttaggtttaggtacacaagagccgatgagcagttggggggctttattaagtgatggtgccgctcaaatggaaacatcaccgtggttattggcattcccagcctttttcctctgtttaaccttgttctgttttaactttattggcgatggtttgcgtgatgccctcgatccgaaagacaaataggaagttgcacaatgaaattattagaagtcaataatttagatgtctatcttaaaaccgatcaagaattggtacacgcagtgcgttcggtttctttcagtgtggaaaaaggacaaactttagcgattgtcggcgagtcaggatcagggaaatcggtcacttcaatgtcgataatgcaattgttgccacataacattgttacctatggcgaaaattcttcgattatttttgaagggcaagatattttacgtttctcagataagcagatgcaatcattgcgaggtgatcgtatcggtatgattttccaagagccgatgacatctcttaacccatttatgcgaattggggaacaggttgccgaagcggtgagtacccataatccattgctgagcaaacagcaggctcacgaaaaagcattggcgatgttacagaaagtaaaaatcccggacgctgagaaaaaaatggtctgctatcctcacgagttttcaggcggacagttgcaacgcataatgattgcaatggcaattatcaatgaaccagatttattgattgcagacgaaccaacaaccgcccttgatgtcactacgcaagcggaaattttagacttaatgcacgatctacaagcggatatgggaatggcgatcattctgatttctcacgacctccgtttagtgcataaatacagtgacgatgtatgtgtaatgcaaaatggcgaaatcattgagcgagggaacacagaagaggtctttaaaaatcctcagcacccttacaccattgaattgctaacgccgatcccaagtgatctaaaacatcaagttgcagaaaatgccccacaactgatcacgacagagaacgtggatatagattacattttaaaacgcaatctatttggcaaaccgaccaaagtgtttaacgccgtgaaaaatatctccctagagctaaaagtaggcgaaactttagggatcgtgggcgagtcggggtcgggcaaatcgacactcgggcgagcgattatgcagatcttagcctatcgaggaaaaattgcctttgcagatcaagagatcgccgcattatctaacgaacagcgtcaagccttgaagaaagatatgcaaatggtattccaagatccgtttaactcactctctccacgcttgacggtaggggagatcatcggcgagggcttgtctgtgcattatccacaaatgagcaaagaagagcgtcgccaaaaagtgatgaaaaccttggaagaagttaatctttcgccatcaatgatcaaccgttatccccacgagttttcaggcggacaacgccaacggattgcgattgccagagcgattattcttgagccgaaattcgtcttacttgatgagccgacttcagcccttgaccgttcaacacaattgacggtggtggaattgctgaataatctccaacgtaaatatggcttaagttacatctttatcagccacgatttagcagtggtaagagcattgagtaacagagtgattgtgatgagcaaaggggaagtggtcgagcagggcgaagccaaacagatcttcgagcaaccaaaagatgaatacaccaagcggttaattgaagcgtcgaatttgtaaattagcaaggcatagtagaacaggggaatttatctttttctactatgccaagttttaggtaacggtattaacaaataccattcttaatattctcaagctcttcccaacgttcaaatgcttgctctaacgccatttcagcatccgccagtttttgtaactgagcttgagtatagctcggctctttagcaaagaaatccgcactattcacttcggcttgtaaggcttcaatttctgcttcaagctgttccattttttcaggtagggcttctaactctcgttgttctttataagaaagtttgaccttcttcccctctccctgcttgcgagaggaggtgtccgcaggacggagaggggcattttcgctttcaacaagcggtgctttttcaacatttttttgcaaagctccactaccctccccctgtttacggggggaggtgtccgaaggacggtagggggcttttgaggcaaaataattctcctgttgttgcttcgcatcgtgatagccaccaatatatttattcacaaccccttcgccttcaaagatgtagcattccgttgcggtattgtcgataaattgacggtcgtggctgacaataatcaaagtgccttgataatccgccaacatctcttccagtagctctagggtttctacatcaaggtcgttggtgggttcgtccaaaatcagtaggttatttggttttagcaataatttagctaataacaagcggttacgttcaccgcccgataaggctttgactggggtcatcgcccgttttggtggaaataagaaatcttgtaaataaccaagcacgtggcgttttaccccattgacttcaatatcttgtttgccgtccgccacgttatccattaccgttttttcaggatcaagctctgcacggtattgatcgaaatacgccacttctaacttagtgccacaacgcactgtccctgcggttggctgaatttcgccaagcaatagtttaattaaggtggttttaccaattccgtttgcaccgataaaagcaattttatcgccacgcaaaatggtagtgctgaagtttttcagcaaggttttacctgccacttcgtagctggcattttccacttcaaacacaattttgcctgaacgagcggtctgatcgagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtctgatcgagctgaatttttaccgtgccttgtacttctcgacgtgctttacgctcttctcgcaaggctttcaaggctcgcacacgcccttcattacgggtgcgacgagctttaatcccttgacggatccaaacttcttcttgggctaattttttatcaaacagctcattttgtaaggcttctacacgcagatcttcggctttggtttcaaggtaaacatcgtaattactaggataggaaaccagtctgccccgatctaaatcgacaatgcgagttgccattttgcgaataaaagcacggtcgtgagagatgaaaataatactgcctttaaactctaataacagattttctaaccaagcaatcgtgtccacatctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcgtgtccacatctaaatggttggtcggttcgtccaacagcaacacatcaggatccgccaccaacgcacgtgccaacgccgcacggcgaacccaaccgcccgacagctcacacaaccgtttttcaggatcaagctctaatagtttcaaggtatcttgaatacggttttcaaactgccagccgttagcgtgttccagttgagcctgaacttgcgaaagttgcgacatcagcgtatcgctgtaatcggtcagcatttgttgcgaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgatattgctttaaaagatcggctaaatgagcgatcccttctgcgacataatcaaacacagtatcttcaatatgttggggcggatcttgttctaaacgggtgacaacaatatctttttcaaaaatcaatttgccatcgtctaactgaacttcgccagccagcactttcattaaggtcgatttgcctgccccgtttcgtccgacaagacagacacgttcgccctgttcaatatgtaattcggtgtgatcaagtagtggatgatcgccaaagcctaaataggcgttagaaaggttaattaaagccatagaatatctgttgaaataaaaatttcgcaaattttagcagttttcccaccgcttgtaagtgatttaataaagtgaagtaatgaaagtataaaagtggtttgagattgtattaaacttagtgagattgtactgatttgggaggtaatggaaagagaagctattactgcccataggtaatactgttctttttgtgtatgaagtttattacaaagtttgctacaatccatttccatcatagacacggaggcaaaatgcaagttgttacaaagctcatacctaccaaactgatttccagtaaatctacgcacaacgcacgttcagcaaatcaaaacattgaacgtagtgagcttttaaaaaaacttgccgatgttccacactaccctttaaccgtcgtgattgcccctgctggctacggcaaaacgacactaatttcccaatggaaagaacgcttattagcgaaaaatgaacaagtcgcttggtttgctttagatgaaagcgataataacgccgaacagttttgtcactacttttcatcagcattaaccaaagctacaggcatttcattacaagggatcacctataaaaataacttggtggattactttgggcaactcttaatcttacttgataatgttccccgtcgattttatctgattattgatgattaccatcttattgataatcccgaaatccacgatgcactgcgtttttggttgaaacatcagcctgatacgatgagccttgtgctactttctcgccttacaccgccattaagcattactaacttgcgtattcacgaaaaactgcttgaaattgatgtacatcagcttgcctttacacctgcagaaacccgtcaattttttgaacaaaagctaaatgaaacattaagtgacgaagtgatttttgcgttatgtgagcgtgtggaaggttgggcaacggcgttgcaactgatgatctttgccattaaacaaaatgcaaaactgttacatttccctgaaaaattactgaccaagctcaatcagcaacatattgctgactatcttaacgaagaagtttttcattatgtcgatcctgacatcaaacgctttatgcaacgttgtgcgattttacgttcaatgaatgaaaagttggttgtagctcttactcaagatgaaaatggggtcaagcggttagatgagctagaaaaattgggattgttcatcacacgaatgacccacgatgatgacgaaatctggtggaaatttcacccgattttagccgcctatctctcacaaagttgtcgcttggaattaccaaatgaatggcaacagctacaccaaactgccgcaatgatgtggctaaaacttggctatggctcagaagcactttaccacgcacaaatgctagacgatccacaaacgctctaccaaatactgcaagaacacggctgggcattattccatcaagggcaactcaaattattggaagactgtttaagccacttgccatcagaacagatatggcaaaatgaaaatcttgttctactcaaagcgtggttagcacaaagtcagcaccgtcaccaagaagtaagcggtattttgcaaaaattccaaccaaagttaccgcttactgagagtttgcaagggcgttttcacgcattaaaagcccaagtggcaatcaatgcaggcgacgaagagcaagcctatttaatagcaaatcaagccttagccaatttgcctgatgaatttgattacgcccaaattgttgctaagtctgtgattggcgaagctcagcattgccgtggttatctcaaagaaagtttagccttaatgcaacaagtcgaaaaaatggcaacgagccaacgggcgtatcaccactggctttggtctaaactacaacagtctgaaatcctgtctgcacaaggtttttggcaatctgcctatgatttattaaaagaaactaccttacaaaccaaagaatttcatcaaattccgatgaatgaatttttgctacgcttaaaagggcaaattttatgggaatggcaccatcttgaccaagctgaagcaatggcaaatgcaggtattgaagtgttagaaaaggaagaagaacgtattcaaagccttgccttattagccaaaatttccctaaccaaaggggatttaaacaacgcagaacgtctaattgagcagtgccgaatgctactggctcgttgttcgccccataaagactgggtaacagcacttgatgaaatccagctaatctattggcaaatgcggaatgaaactcgctatttagaaggctggctggctcaagccaatttccctagtcaagagcataaccactttacccaacgccaatggcgaaatatcgcccgttgttacctgctacaaggagattacgaacaagcattgcgtattctcaacagcttactacgtactacagcgatttttaatttagtgagcgatagccaacgtgcattaattttgcgtaatcgagtttacactttacaaggcaagcctgatttagctcaaagagatctcattcaagccctaaatttaagccaacagaccaactttatcagtgcatttgtgattgaaggcgaaataatggcacagcaaattcgccagctactgcaacttaatgtattagaagaactttctacccataaagcccaatttattttgcgtagcattaaccagcataaccgccataaaacagcacattttgatgaagagtttgtcaaaaacttacttgctaacccacaagtgccagaactgctcaaaatcagtccgcttactcaacgagaatggcaagtgctagggttaatttattcaggttacagcaacgaacagatctctcaagaactggttgttgcaatgaccaccattaaaacccatatacgcaatctctaccagaaaatcggcgtggcaaatcgtgctgaggcgattgaatatactcgcagtttgttgcgaatgatggggtatatctagataaagtagaaaatcaacaatcaatttagaatctattcttcatatatatttctttttatttaagttgttttagtgtaaagtttggatgtatatgaatgtggatattattttatacaataatattttctattaatctaattaatgtttattggtaaatcactattatgattttttcaaatgtgatttgatataagagagaaatataatggctaatttgtcccctgatgaagcaattgagcttgcatatgatatttttttagaaatggcttcagataatttagagcctgcagatattttactttttaatttgcaatttgaagaacgtggagcggtggaaatggttgaaactagtgaaaattgggagcaagaaatcggtgttttaattgatccagatgcttttgctgaagtttggattggtttgataaatcagaatgatgagatggatgatatttttgcacgttttttaatttccaatgatgctgagaatagagaatatcatgtaatttggaagagttagaggatgtaattgaggggacggagtcaaggtaacattaatttattttagtctaatctttttaatctggatataataaaggcagcttttgagaagctgcctttatagtcattatttttcgatctcttgtggcaacgccaacactgtttccactggtttggcttcgacattgacctctttcagatcttcttgttttaatctattcgctaattcgacatcgtgggtctgttctgcgacatacagtgccataatgcgatctttcgcgatacactctttatgctcaagcagttgcacaaagtaaggtttcgctttgtcgaaatgccctgctctggtgtggatataacctagtactcgcgcgtaatcgtcactgtaacgctcttccgctttgctgttgcgttttaagagaactttgaatagtttatgctcttcatcaacttgtaagcgtgttaattctggatagagcaacacaagttgttcatcttgatattttttcacagtttcaagagcgatttcttgagcagactcgtgatcgtctgtgtcaattaagcgtttaatcaagccaacgcgaacgtaaatagaacgacggcggcggcttggttgattatcccaccattttaataagccctcttgaccttcttcattcataatttcatctaataagccgtcattgacttgctgttcaagtctttcgtactcttctgccgataagaaactacgttgtccgatttgttctaatacgtcatcgagtgctttgtaagccttcgatttttggtagatttcaatcgcaaggcgtaaggcttcaacgttgtttggagcaaggactaataagctatcgaccgcactgcgtgccgcagggagtttgccttgtagcagtaaaattcgtgtgcgagcaatttcaacggcaacgttgtttggccctgcgattttagcagcttcaattaaatacttgttcgcattgagttcatcgcctcgttgttgagcagcttcggcagctttgatgaagtttaacactggctcggcggcgtgttttgcattttttgcaattaatctctccgctttagagtaatccccttcggtcattttcattaagccttcgagggtttgctgttgtgcttttttacgtttgcgatcgccaaaccattgataagcacctcggcttaacccgaagaaacggcggaaaatccactctattgcataaaccaccgccattgccaccgcaaaaaagaccacgagcattacgaggctcatttcaatcactttgcctgcggtttcaatgcgtacataaccttgatgccccgaaatataaggccctaaaattaagcctgcaaggacaattagcattaaaaagagaacgcgaaacataatctatctcctattgttgctctgtagcaggttttgcttcggttggtgcttcttgagctggtgttgcttgctcaagggatttgtcttgttccaactgaattttgctaatcggtttaggagctttattgagcagttgatctaataaacctaaactgtgcaggcgatttggtgcgtcaatgtagatagattgttcaatcatctcgtcaatttcttttaagaaggttttgacttgttcattttgcacatcaaagtaacttctcacccaagtgctaactgcctcaagcgattgtttatagagttcattttgctgacgtggaattgccaaaatcgcaatttgtaaacgcaagcggatattttctcgtaagtaaatctcttgatttggtgcaacaaaagctttctcttttgccgtcgctttatcgctgatacggataaagtgatttaagaaagagtttgcacttttttctaggttttgttgccagtcttgcactgagttactcacttcgccggtggcaacactttcttcttccaccgtgttgtcgatcatcggcatatcatcaagcaaattcgctaattgcgttaatcgttgcattaaattattttgatcaacattgtttacactagcaagttggctgaggtcttgtttaatcgcttcacgaatgttaagaactcgattatcgctcacttggcttaatacgttatccgcttcaataagcaagctacgagctgtatcaatatcgttatctaacactactttgcgtaaggcattgttaagtaagaaatcagcgtcagataatagccattcactttggtctgcttttggtgtcgcccctaatttttgaatttggctttgtagggcgttgatttgctgagtataagccgtttgtacattctctaactgtgcaattttatctaatgattgttgataatcttgagtaagtttggcaattttgactttttcttcatcaaagttagggatttcagcaactgtttgttcggggtgattttgggttgcttttgcttgtaatgcttgaatttgtgtatcaagttgagcaaatttttggttgccgaagaaataccctgttgcccccacgcctaaggcaatcaagatagccagcagagagagtgcttttccccctgatgattgttttggttgttctgattgaataggttgagcaatttccacttgtttttcctcttgttcagtttttggatcaatagcggtgacttcctctgtctcttttaccatttctggctcagaggctaccgcttgttctacatcgactttcacatcttcagtcacgactggctcaaggttttctgcaacgttttctgttgcttcaaccgcttttggctttttgctctgtttcgacataatgttcacctatttagttaaaatttcacacagttgagtattgtttccagcagactatgattatccgctttcattgaaatttgaatttgttcgcttttccagcctgattttcgggcaagtgtggcgatacgtttgccaaccacaattaaacgacattggtagagccaaggcagatccgcttctgcggtctgttcgataaacgtggttaaaatctcaccgcttgtcacgacaatggtatctgttcctgctcgttttgcgaggcttatctgctcgcttaaattgtccgtcaacattatacggcgataacattcgaggatctgcacttcagcacctcgtgaagttgcttgttcagcaaaaaattctcgccctgtatctgcgcgtaaaatcagcacattttttccagacaactgagccatttccggcaatgccagtagcccttcactgttttctgattgaatagggtaacgtaccgcttgttcaatttgggaagcgaaatggtttgctgaacgttgcccaacggcaaaatagagtaaatcacttcgccagtaaaatcccgtttgctttaaggtttcagttgcaaaatcaacggcattttttgacacggcaaaaacataatcacccgaatttaaacgagataaactgcttggcaaagtcggtaaatccgcccctgcttcaactcgaaacagcggttgatgaatggcaaaaatttgctgttctgccaacatttcaactaattgttgccctcgttgatcgggacgtgtaactaaaacattcatactattcgctttgataaacggtttttaaaatgtgatcagccccttttgcaagtaacgcttctgccacttcaacacctaatttctctgcctcttttatgttgccttttgctgacgctcttacaatggttgaaccgtctaacgaaccgacgagggcatttaattcaatttcatcacctgttaatgttgcaaaaccgccgataggcacttggcaaccgccttgtaaacggctgttcattgctcgctctgcttgtacacagtaagcggtcggttggtgatttaattctgcaagataggctaacactcgctcgtcattcaaacgggtttcaatcccaactgccccttgcccacaggctggcagtgatgtttctacagggataaaggtgcggatacgttcgcttaagcctaagcggattaagcctgctgaagctaaaataatcgcatcatattcaccattatctaatttgctcaggcgagttccgacgttgcctcgtaaggatttgatctgtaaatgcggatattttgccattagctgacattgacggcgtaggcttgatgtccccacaacagcccctgctggtaaggcttcaaggtttgcatagtgattagatacaaacgcatctcttggatcttcacgctcacaaatgaccgcaagccctagcccttcaggaaaagtcatcggtacatctttcattgaatggacggcaatatctgctcggtttttgagtaaggctaactctaactctttgacaaataaaccctttccaccgatttttgctaacggtgtatctaaaatgatgtcgccttttgttaccattgtaaccagctcgactgataattgtggaaaacgctgttctaatgcgtctttaacgaaatttgcctgccaaagtgctagaggactttgacgagtagcaatgcgtaaaatctctttcattcgtttacttttctttaaataaagatagccgttatcctaccactatttgtcctttcttgccaaaaaaattgaacagtgatcttgacgaaaataaaagaaacattaaaattcgcaacgctttaaaaaagcagttcggatgaagatagctggagagtggggaataaccctacaccgacgaggtaaaatctttcaggtgcgacagcgaggacagctattggacgaacccttggagagatccactctgcatagcagaaaatggacgccgaaggcgaaagcaatgaatgcgaaacgctcaggcaaaaggacaggggagaaaagtaaccatcatttcaagcggtgggattatatttattgcttttgtgtcaggtatccttgaaacacgcaaaaaattcatcacatcattccgcttgtcttattgcttttctttccttgtaagttatttttacgaggaattatttatgtcaattgacatcattcttagctcaataaatagtatcgtttggggaccaccactgttgttattagtttcaggtgtggggatctacttcacccttaaacttaaattactgcaatttttccacttacctagagccttttcttatatgttcaaatcagaaaaaggcgataatcaatcaggggatatttctgctttaggtgcattagccactgcacttgccgccactatcggcacaggtaatatcgtcggggtcgccaccgctatccaagctggagggccaggagcggtattttggatgtggatcattgccctgtttggtatggcaactaaatatgccgaatgtttattggcggtgaaattcagaggcaaagataaagacggctatattgctggcgggccgatgtactatatcgaaatgggtatgggacaaaaatggaaatggctggcaaaactgtttgcgatatttggggtaatggtcgctctctttggtattggcactttccctcaagtcaatggaattaccacatcattgcaagatacgttcaacattccgattagcattaccgccgttatcttaacgcttaccgttgcggcaattacgctcggcggtgtaaaacgtatctcaaaaatttcaatggtgatcgtgccttttatggcggttagctatgttggggcttccctgctgattttagtgcttcacgccgataaggtgccagacaccattgtctttatcgtaaaagccgcctttaacccagaagccgcattgggtggtgtatttggttttaccgtattacaagctattcaagctggggttgctcgtgggattttctctaacgagtcgggcttaggctctgcacctattgccgcagcggctgcacatactaaagagcctgttcgtcaagggttgatctcaatgactggcacattccttgataccattattgtctgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgacaggcttagtgattgtattaactggggtatggacaggtccaacacaaggggcagttttaactaacttagccttctcagaaggtttagcaagctctatcggagcaatgattgtcaccatcagccttgtattttttgcattcaccacaattttaggctggtgttactacggcgaacgttgtttagtctatctgacaggcggacgcaccaaaaggattaaactctaccgcttgatcttcattatgctgattgccgtggcaccatttatcaaactcaatacgatttggacaattgcagatattgtaaacggcttaatggcattccctaacttagtcgctttgatcggcttacgccacattgtgattgaagaaaccagaagttattttgagagattgaagaaggggttggtggagtagttatgatagattttaaatatctataggaatttaaagtcttatgtgaaacgggctgtattaagggaatacagcccgtttattataatctaatcaattagtttacgcttttgcctgcgtgcgtttacctaaaatcaccgtcaccacaaacgcaatacttgctgaaattgccataccaacactgtacattgcaaggctttcaggtttaattgatggaagaccaggtaaacctgctgcacctaatgcgattgcttttacattgaatagtgcgataaatgcacttgatgtacctgctgcaatcattgctgcaataaatggataacggtaacgtaagttcacaccgaacattgctggctctgtgatacctaataatgctgagatacctgatggaacagccataccacgcactttcgcatctttcatcacgaatgctgaacctaaacacgctgcaccttgagcaatgttagacattgcagcgatagggaagataaatgtaccgccagtgttcgccacttctgctaataattgagtttctaccgcaataaaggtttggtgcataccagtgataacgattggtgcgtagaatgtaccgaagatcgcaccgcctacaaagcctaagctatcgtataaccaagttaaacctgcagagattaatgagcctgcttcacgacctaatgggccaatgatagtgaacgctaagaaacctgcgatgaataatgagaataacggcgtgattaagttatccaagaatgatggaacaactttacggaaagctttttctaaagttgctaatacccatgcagaaactaaagtagggataacagtaccttgataacctactttctcaatttctaaaccaagtacattccagtactggattttgccatttgcaagggttaatgcatagttccaaccgtctgctaatgcagggtgaactaataacatacccagtgcagcccctaagaatgggttaccaccgaatttacgggttgcagagaaacctaaaagaactggcaagaacacgaatggtgcatttgcgaaagtgttcattaagtccactaaatccgcaatacctgggtacatatcaacaacattcaaaccttctgcaaagaagccttttgcagtaagcattgagtgaatacccattaacaaaccgccagcgacgatagccggaatgataggtacgaaaatatccgctaaaccttttacaacgctttgtaagaaaccttgtttgtctgcaccagcactagcaacttcagatgtggtcatatcaccaatacctaatgctttggttaattcagcgtgaactttatttactgtgccagaaccaaaaataatttggtattgacctgcaaccgagaactgacctttaacgccttcaatgttctcaatgccttctttatcgattaaagtttcatctttaaccaccatacgcaaacgggttgcacagtgtgctgcggcagagatgttatctttgtccccgagtttatcaatcacttgttgagcgatttgaggaaagttcatagttaccacctattttttgtgtatagaaatactaaaaattaaacagtgatattttaactaaaacggtttagctaagaaagtaaattttgctaaaacgttttagttttgtaatctagatcacatttttagcaagtttagctattatgagaataatgcgtctgatagcatatgaaggatttgttataattgaacattctcagtgttacaaattagagaaaacaaatatattttttaggaaatatggaacttatttttaaaatgcttctctaatttatgcagaagttaattctattttcttatagaacaggagaaacaatgaaaaaatcattattaagttacagtttatcgttaatcttaggcttaggagcgatggcttccttgcctgtttttgcaaattctgcaacccaacctaccgctatcacaaatactcaacagcagttaggctttgaactaatcaaaacaaccatcaataaaagcccaacggataaagctatctatcaaggtattcgccttgcgaatggaatggacgtgttactgatttcagatgacaaagcaaataaatcgctaatgtctgtcggcttgcctgtcggttcaatggacgacccagttaagcaacaaggtttggctcactatttagaacatatgattttgatggggtcaaaagccttccctgaaaccaacagcttagatggctttttaacgaaaaacgggggctacaataatgcctttactgcgtcagatcgtaccgtttattatcttgaagtaaataacaacgcctttgatgaagcggtggctcgccttgccgatgcttttgctcaaccgttgttatctgagacgaatgctaaaaaagaagtgaatgcggttaatgcggagatggtgcgagcaaaatccaacgatggctttttaatgcacgatgttaatcttgctaccgctaacccgaaccacccgattaccaagtttgccgttgggaataaggtcacgctatctgataaagctgatagtaagctacaagatgaattagtgaaattttatcaacaatactattccgcaaacttaatgaaagcggtgctttattctaatcaaccgattgaaaaactggcaaaacttgcagaacagaccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcaaggttgagaataaaaaactcacagccccgacggtggatatgccatttttccgtgcggaagataaagcggtgatgatccattataaaccggtgaaaccaagcaagatgttggcgatttcctttgatatgcctgaagataaagctcagtttaagcataaaacaggggcgtatctcgcttatgtgttcaataataataccgatggcacactgtctgattatttgattaagcaaggactgtctgacagcggtgttcaatcggtagcgaatcatgatgttagtcgcaaccgtggtgattttaccttttatattgaattgactgacaaaggcttagcagaacaagacaaaattatctcgttggttttccagcaaattgaagcggtcaaaaaagcaggtattcaacagagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgatgaattaaaagagagcttaagccaagagtttcaacatctgcagacggaaaaaagtggcaaactatgagttatccgctcgaaaatatcatcgatcagccttatgctattgaacaaatggatacgcaagcgatcaatgcaaaacttgctgagatgacattagctaacgtgcgtattttgctcgttgatgataaagcgaaaaccgataaaaaaaccaaatattttgaagccccttatgccgtacataaaatcagtgagcaacaaaaggcaaaatggcttgattttagccaaaatcctgagcttaaattgccagcgttgaacccgtatttcgcaacggatttcagcctaaatgaaagtgataaatctcgcttaaaaccgcaactgattgaagcagagcaaggcacgcaaatctatgcaatgccaagccattattttgctaacgaaccgaaagcgaaaatctcgttagtgctaggcattacgccaaaagtggaagatcttaaacaagccgtcagtgcagtgttgctgggctatatgggcgatttagtccaaagcaaaattgatttccaagcctctattgcaggaatgagtgcgagtgtatcaatggcagaaaatggcgttgtattacaagcggatggttacacccaaaatttagcaaaattgctgaaagataaaatggtgttattccaacaatttacgttaagtgaagataccctagctcaagcaaaacagcgttatcttgaagccttagatcgtgcagaaaaagagaatgctttacgccaagcaaatgaggtaattactcgtttctccagttatccctattttgaaatggcaaaacaacgagcaatgatcgagcaggtcagcttggcggatattcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgcaacgccgaaagatggcccaagtgcaggtattgcaatgtgtactgcattaatctccagcttaacgggcaatccagtgcgtgcagatgtggcaatgacaggtgaaattaccttgcgtggtaaagtcttgccaatcggtggcttaaaagagaaattgttagcggcacatcgtggtggtattaagacagtgattattccaaaagagaatgaaaaagacttggaagaaatccctgaaaatgcaaaacaagctctagccattcacgctgtggaaaccattgatgaagtattggcaattgcattacaaaatccacctgaagggattgagattgtgtcaaaatctattccatcaattaaagtgaagaaaacaaaggctcgtccggctatgcaataaatagttgatactagctaaggtgactatgcctcattatttagagtgtaatagacaaattttctgctaaaaatggcttaaagccttgtactatacggtattataggctttaagccgttttttagccgtcactttgtcaactatgccaaacaatttcaaaattagagaatcgctctacgcaaaatttgaatttctactatctaaataatcttatttactaaaaacgtcaaaacttcataatgtgccgtatggggaaacatatcgaataattggacttttttgagttcataatggctgagtgaagcaaaatcttttgccatcgtttctgcattacaactggaataaatcaagtaaggggagccgagttgattgataaattcggctaacggtttgccgatgccccgtcttggtggattgacaatcacgagatcgggcgttgttccttgttcattcaaggcaaattgagccgagtccaatgaggcgaatttgacattttgtaagccaagttgttgggcggattttgtggcactggcgatagcagaggcagaaatctcaatgcctgtaagtgcgacgttcggattggtggcttgtaatgtgtgggcacaatgtagcccaaagcccccaacaccgcagaacagatcccatagttgagtaatcggcaatgcttttatccacgcttgagcagtgtgataaagttggctggcgaccgttggattggtttggaaaaatccttgcggacgaataaacagcggaatttgattaaagcgttcttctaacacttgctgttccgtcagaaaaatctcttgttcaccttccaaaatggcggaatgttgcggttgtatattcaaactcaccaccgatttttcaggcagttgagccagtagcatcggcaattcacgctcaacaagcggtcgttttagctcacttcttaacacaaagcggatcatcaaagattgattatgctgactttgggtaatcaagatgtatttgagttcgccccgtttttttgccacgttgtaaggtacaagcccagcccgtccgataaaggttttcaggatagggaaaagtggtgtaaaggcttgcggatagagtgggcaatccgttaaatccgtgcctgtgccgtcgtcgtttaaaatccctaaaatcgggcgttcaacactgcctgtgaccaccattttggctttgttacgaaaatgtgccaacggtgatgtaaccgccggtaaaaattcggtactttgcaaaagataaggcgaaactaaccgcttgagatcagaggttttctctgctagctgttcggtgtagcttttatgaagccattggcacgaattgcaacggttctgttcaaaatggtggcagttgagtttaggcattttgggctttccattccaaccattgatcttgaagtgtaacaaattgttgatgagcctgttgccaacgtgggctggcggttaattccgaccagctaatttgcttccgtttcattaggcttaagtagcgttctttctgtgttggggtaggttgatatttcaaattatctaacacttgcaccacaccgtcaggctcattgcagagtagtaataaatcacaacctgcttgtaaggctttctcgcttcgttctacatagttccccataaaaccagcccctttcattcctaaatcatcagagaagatcacgccgttaaattgcaactgtttgcgtaaaatctcttttagccagtaacttgaaccactggcaggttggctgtcacattgggtgtaaataacgtgagcaggcataatcgccgataattttcctttggcgatcagctgtttaaacggctgaatgtcgtgattgaagatcgtttcttttgggcgatcatcaaagggcgtttcaagatgagaatcggcaataacgtgaccgtgacctgggaaatgtttgcctgtggttgccataccgatttctcgcataccgtcaataaaggcttctgcgacaggtagcattgtagctacatctttcccgaacgagcgatcgccgattgccttgctacaatgccctaaatccaacacaggggcaaaacttaaatcaatatctaacgcaaacatttctgcggacattagccagccagcttcttgggcaagttgcaagcggtctaattgtaaaaaagattgcattgcaggcaatttggtaaagccttcacggaaacgttgcactcgaccgccttcttgatcaacggtgattaacaatggctttttcactcgttggcggacagatttaatgagggcttgcaactgggctttatcgtgaaaattgcgtgtaaagagaataagtcctgaaaccagtgggtgttcgagtaactcttgttcttcttgagtaagttcgtagccagcaagatcgataagtagcatgataaacctttgtaaaaattattatttttcttttaagaaagtcagtacttttgccaaatcccttgtccgctttgacggtggcagacttttcaaaaaagtcgagccgtattgtcgcatcacaaggcgagcatcacaaataatcacagcccccctgtccgttacatcgcggatcaaacgccccacaccttgttttaaggtaatcaccgcttcgggaatttgaatatcattaaagggatcgccgccttgcaacttacaatcttccattcgagccttcagcaatggttcatcgggggcggtaaaaggcaatttgtcgataatcaccaacgacaacgcatcgccccgtacatcaatcccttcccagaaactttgcgttgcaaccagtacactatttggctctgcaacaaacttctcaagcagacgacttttactggtttccccttgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacacgctcaacgaactctgttctcttaagaaatccgctaaaccacgcatcataaaataggacgtacaaagtaaaaaacaacgcccattattcgcttcaatcacaggtttgagcaactgccccaattccgtcagtgtatgggatttattcgtatcaggcagataacgtggcacacagagcaacgattgacgagcataatcaaacgggctttgcaacaccatctgttctgcattctcaatgcctagtcgctggcagaaatggtcgaactttccgccgacttcaagggttgcagaggtaaaaatccaaccaacttgatttgctctcatctgctcaccgaatttatcggcgaccgtcagtggcgtaatgtgcaagccgaaggaacgcccattgatttcataccaataacaatagccgacaacactagtatcgcctaatctttttaactgtgctttgacttcggccaaacgttcaaagattttatccaaggtttctgaacgaccgagcgattttttcacaacttcgcttaaaaaatcaatgttctcattcagcttagcaaagccttcgaccactttcggatcttgcaaaatttcacgcaaattcccccgcttgttaccgtcccctagcaacaaacggaaatcctgtaccactttttgtagatgatcggacgctttacccaactgagcaagatctttcaactctgtacgataaacaatgttactgtctttgcaaatatcaaataattgacgagatgtcagcgattgcccaaagtactggctagcaatatcgggcaactgatgtgcttcatcaaaaataatcagctctgcatcagggattaactcaccaaagcctgtttctttcacagccatatcggcacaaaataggtgatggttcaccacaaccacatcagcttccaacgccttgcgtcgagcttgtaccacatagcactctttataattcgggcaatccgaccccaaacagctttctgccgtcgaaactaattgcggtaaaatcggactatcttcggcaatggtgatacattcgctcaaatcccctgtttttgttcccgtgtgccattttcgcaccttcgccaaatccgccaacaccgatttatcgccaaccacgcccattgcgatcacctgatctaaccgctctaaacagagataattagcacgccctttcaataacgccacttttcctttatatttcaaggctttttgaatggttggcaaatcacgattaaacaactgatcctgcagatttttagagcccgtagaaatgatcgtttttttgcccgatagcaacgctggcacaagataagcaaaggttttccccgttcctgttcctgcttcaatcaccgcacttttggcaaatttcaccgctctcccgaccgcttgtgccatttctaactgagcatctcgcggacgaaaaccgtgaatgttttggcttaacgtgccttcggggctaaaagcgtcggtgattttttcggatagtttcatttgaataagtaacgtaaagaatcttacatccatgtaagagatttaacgatagttgaagaatggaaaatacatcaataatctgcactcagaatattaaattaacattattttgtaccaaaaatcttatcgccagcgtcgcctaagcctgggataatatagccgttttcatttaaatggctatcgattgcagcggtatagagttcaatatcagggtgagcttcttcaagtgctttaataccttcaggtgcagcaacaagtactaacactttgatttgtttacagcctgcagtttttaaaagatcaagggtagcaatcatagatccacctgttgctaacatcggatcaaccacaattgctaagcgttcgcccacatcgttagctaattttttgaaataaggcacaggctctaaggtttcttcgttacgatagatacccacaacgctaattctcgcacttggaatatgctcaagtacgccgtccatcatacctaaacctgcacggagaataggcacaacggtcacttttttacctttaatacgttcaatttcaactggaccattccaaccttcaatggtaactacttccgtttccaaatctgaggtcgcttcgtaagttaaaaggctaccaacttccgttgctaaggcacggaaatctttagtgcttacatcagcggcacgcattaaaccaattttatgtttaataagcgggtgttttacttcaacaattttcatttttggtctccggttatgtttaaaaaaaatcgggctattctatcagaatttagcaaagaaagtttaatctagatcagataaaagttcccaaaatgcccgaatgatcggttcttgcaaacggcgttgctgaacgcaaacacctaactcaaatgcatcaatcggggtttctaattgaatatgggaaatctggtttgccacagggctttgttgcaccacaacatcggggatcaacgcaacaccacagcccaaggcaaccatcggcacaattgcttcgtgtccttccactgtcgcataaattttaggctctttaattttttgcaatttaaaccaatgatctatccgcttgcgagcaggcccatcaacgggcaagataaaaggcatattctgccaatcaatcggcgttttctgtaacaattgcgttgcagcacaagcaattcgcggggcaactaacgataattgaatatcatcaatatagtgaaaaataatgttattcggcaagttttcaggcttccctgcaagagaaatatccgactgcaacgattgaacgctatacagcgctttagcaggatcgcctgtactcaatttgatctcaatcttaggatagcgttttctaaattttgctaaaatgcgtggtaagtggctgtaagaagctgttacagagcagaaaagtttaagctcgccttccaattcagtttgatttggcgaaaaatgtcgttgaatttgttgccattccgcccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatgatactatcgctcgtgtaataaaacgcattgagccacaagcatttaatgaggtttttcttaattttatcaatgagatacgcacacaacaaggacgtgaagtgattgcgattgatggcaagacacttcgtcatagtttcaatccggaaacccaaagtgctttgcacagtgtgacggtgtggagccagtctcgtggtttgattttatcgcagaaaaaatcctcgggtaagcaaaatgagcagcaggcggtgatggaaattatcgatagtttttgcttaaaaaatgccgttataacggtggatgcgatgaatacacagaagaaaattgccgagaaaatcatcgaaaagaaaggggattatgtgatgccgttgaagaaaaatcaccgtcaatttcagtcggaagtggaggcgtattttcacaaaatcagccgagattgcctcgaaatgcttgagacgtttgaggaggtaaatgcggaacgtcgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcttagaagatcaacacgctctacttactctgctataatgccccacttttattacaagcggtacaatttcatggaaaatttgcaagaacagcctgactggaaaccatcagcctctattcaacacttattgaaacgagccaaaattatggcggagatccgtcaattttttacggagcgtggggtgttggaagtggaaacgcctgctatgagtgagttttccgtgacggacgtacatctttcaacctttagcactcagtttttatcgccgttttcaagccaagcgaaaaccttacacttgattactagccctgaatatcatatgaaacgcctgcttgcctgcggtagtggggcgatttttcagctctgtcgagtgtttcgcaatgaagaagtcagcaaacgccataaccctgaatttacgatgttagagtggtatcgtcctcattttgatatgtaccgtttgattaatgaagtggacgatctgctacaacagattttagattgtgagcctgctgaatcctttagttatcaatttgtatttcagacctacgttggcttagatccactctctgcgaccaaagcccagctggtggctaaagcgcgtgaacacggtttacaatgtgatgaagatgaacaacgtgatactttactgcaatttttatttagcgaagtggtcgaagcgaatattggcaaagagcgtccaacggcagtttatcacttccctgcaacccaagcggcactcgctcaaatcagtacggaagatcaccgtgtggcggaacgttttgagttttattacaaagggttggaactcgctaacggcttccacgaactcagtgatgccaaagagcaaattcgccgttttgaacaagataatgtgttgcgtgaagcgatgggtttaccgccacagcaattagacagtcgtttcctcgaagcgttaaaagctggtatgccaaactgctctggcgtcgccttgggggtggatcgtttaatgatgattgcgatgaatgctgacaatatcgatcaagtgatggcatttggggtggaaagggcgtaaaattgattttgtacgtctaactgatatacaatttcaaacaacagggggattttatgacaacaatggcaacgagccgtctagctgctcgagtaaaaccagatacttacgccttaattaaacgtgctgcagaaattgaaggaataacgctcaccgattttatgatcacgaatttacaagccgccgctcgtaaggtgattgctgattcagaaattattcatttatcacttgaagatcaacaccgttttgcagactcattacttgagccacataaacctaacgaaaatatgcttaaggcaatgcaagattaccaagctatctttagtaaaaaatagatggatattgcaaaactctcttttattcgattttcggatttgaccattccaagaaacacctttagctcttcttctgaagagctaaatagctatttttatgcgcaagtttctcaagacatcaaaagacgagtaacaaattgctttgtgttaattgatcctgaaaatcaaactatagtaggttactatactctcgctgcttctagcatttcactaaaagatcttccggttgagaaacagaaaaaactcccccgttatcctagcgttcctgtcgttcggcttggtcgtttagcattagataaacgttatattggaaaagggctgggaagatttctgttagttgatgctatattacgagtagtcaatgctgatattgctgcttatgcgatagtcgtagatgctaaagataaaaatgccactgctttttatcaaaaatatggatttttatcttatgcagataacgacaaacttttatattaccctttatcttattggaaataacaaaggaacaaccttgaacaatttatttattattgactcacattgtcacttagactcgttagactatgaaactcgccataaaaatgtggacgaagtgatcgacaatgccaaagcgcgtggcgtacagcagatgatctcgatttgtacgacacttggtcgctttgaagcgatgaagcaactcactgctcatcgtagtgaagtggccctctcttgtggtgttcatccgttgaacgtggaagatgaaccgtttgactatgataaactggtggcattggtgcaagatcctagagttgttgctgtgggggaaacggggttagattatcactacacgcccgaaaccaaagcactacaacaatcgttgtttgagcaacatatcgaagttgccaaacaggtgcagaaaccgttagtgatccatacccgttctgctcgtgaagatacaatgcagtttttagaacaagggaatgccgagcagtgtggtggtgtattgcactgctttacggaagattgggcaatggcaaagcgtgcgttggatattggtttttatatctcgatttcagggattattactttccgtaatgctgaagaattgcgagatgtggtgcggaaagtaccgcttgatcgtctgttagtcgaaaccgactctccgtatctagccccgatcccttatcgtggtaaacctaaccagccggcttatgttcgagaagtatgtgaatatgtggcaacactaaaaggcgtatctttagaagaatttgctaacattactacgcaaaacgtgcgaaaattgtttaaaatttaatggttatattaatgccgaactttcggataaggattttttatgagagcaatgtttaaatactttctgatcttagtatcactctcgctacacatcgtattagttggtggggtaaattatgcatttcctagctatgagcaaacaatggttactggaatggaagtgcgtcgtatggataaagatggggtaatcagcaaatcaaatccagcagatggtgaagtgcgtgatgtgtattttctgttcaccgaacacccagataccaaagcggtaatggtgtatcgtaatgaagatacaggctggggattaccgctctatttcaaatttggctctgccgatattcaagcaaaagcacaagcctatgcgaacgaaaaacagatggtacaaattaaatactacggctggcgaattaattggttgaatgaatttagaaatatcgtgtcaattaaaccacttgctgaaagcgaaaccgtatcaaaaccgtgggtaagctatattttatatgctttctttgcattgacgttcttcttgtctgtgcagtttattcgtgggtggtttgatagtagtaaataatgaataaggacgccaagcgtggcgtccctaccattcttcaattcaccttatttttacatcttgtagggacaccacgcttggtgtccccaatgaattatcgcaatgaccacctactttatcgccgatcttcatcttaacgacaatcaacccgaattgacggatctgtttttgcaatttatgacagaaaaagcaccgcttgctgaagcagtgtatatcttaggggatctgtttgatttctggattggtgatgatgagcaatcgcctttaattgataaagtgaaacacgccattcgtcagcttacagatcaaggcattccgtgctactttattcacggcaatcgtgactttctgattggtaaagcttttgctaaagccacaggaatgaccttattacctgattatcaactgattgatttatatggtaaaaaaaccttaatttgtcacggtgatactctttgtattgatgatattaaatatcaacaattccgccaaaaagttcatcaaaaatggcgacaatggctatttctctgcttaccactcaacctgcgtattcatatcgctcaaaaaatccgagctaaaagccgtgcagacaaacaacaaaagtcggctgaaattatggacgtcaatcctgaatttactgctcaagttgtggataactatcacgctgaatggcttattcacggacatactcacagacaagcggtgcattttagtaaaaattttgcaaaatctgaccgcttatttactcgcatagtccttggcgattgggggaaaactgcatctattttatctgtatcacctcaaggttttgcttttaatgaggaacgttaaatgatcgatgtgattatcccgtgctataacgcagaacagacccttcaacaagcagtacaaagtgtgcttaaccaagctgaattaggcacattatggatcattgatgatgcttctaccgataacacctttgcccttgccaaacagtttgaagcacaagttccacataagattagagttgaacagatgcctcgaaatagcggtgttgcaaaggctcgaaattgggggcgttacaaagtgatgcagaggttatcgcttttcttgatgccgatgatgcttatgaaaatggggcattgcaagttgccgaagcaattttccatttccgtcctgaagcaatggtagttcgccttgccttaaagcctgttggtattgcagaacgctatgcttctcaccctaattttgagtatgcgtggcaacatatgcgaatgacctgtggtggaaatgtggtctttcgccgtgcattcctccttgcttgtggcggttttccacaatatcaactatttagggaactgggcggtgaagatggtgctttaggcattgcaacgaccaaaatcagctatgtcgcaacggcatttactgaagcgggcgtattacattactgccgtgacggtatgcacgcagaacgtttgcttgacgcagttctctttaataaacaccctgaaaatgtaacggaagagaaaatggctcaagccaatgcggtgacagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaataaaccccctgaaaatgtaacggaagagaaaatggctcaagccaatgcggtgacagacaatatttgccaacaaatcaccgcattagtccaccatcttaagcaagaacaggcaggaatatatccgcttgtgttaactcgtgaagatattgcttagattgaagttaggtcattgctctaactgccttgacaaccccaacaagatgactaagtttagttaaaatctcagtaagatgtgttctgtctttcacgctgaccaataatttcacttgatacacaccaccttctcgctgttggctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatcaaggatattgctgttcattttggcaatcgcagaagtaatcccagctagaatgccttgttgattgagaatatcaaccacgatttctgcttcaaattcaacggatttatctttagcaatttcccagcttaccggcatatagtgacggtgatccgtcgcagcttctttcacattgcggcacgttaagcagtgaaccattaaccctttgcccgaactgatatgcgcaataatttcatcaccagggacaggtaaacagcatttcgcaaagctaatcaaaccgctatctaccccttggattgcaagagattgattattttcaggattaccgtctgtatcaatttctaaggtcttactagataagcgttgagcaatcactccactaatttgattacccaaaccgatttcggctaataggtcatcaaaattggataattgtagatctgttagcaatgcctcaattacaacgggatcaagatgttcaaaattagaggtattaagtgagagcaataattgtcgtcttccaagagaaattgcctgtgtacgctgctggttttttaaggtgttacgaatacaagagcgtgcttttgccgtgaccacaaagttcagccacaatgcatttaaccgtggactttctgccgtttgaatttcaatggtttgccctgattgtaacggctgagaaagtggatacggctgatgatcgaccactgcaccaatacagcggtcgcccacatcagtatgtaccgcataggcaaaatccacagcagtcgcattggctggaagctgtacgatacgacctttcggagtaaagacataaatgtcgcttgaaaacagatcagatttaacgttttcgataaactctgccgaatttcctacattttgttgcatttccacaatactttttagccattgttgcgttctgacttgaacactcatattagcttgttcttgatagccccaatatgcagcaacaccaaaacgagctgcttgatccatctcttcagtgcgaattaatacatcaacaggcacacctttagggccaatcattgaagtatgtaaagattgatagccatttgttttaggaaccgcaatatagtcttttagttggaaaggacgaggtttatatagactatgcatctgccctaatactcgatagcaattatccacactatctacaacaactcggaaagagtaaatatccaaaatagaattaaaacgttgtactttttgcagcatacgtccataaagataatagagatgacgttccttaccatacacacgggctttaatccctacttcatcaaggcgaatttgaatttcctttgaaatttgttcaatcagcccttgacggcttcctctagccatatcgactgctgcttttaacaccttataacgataaggatacattgcttctaaacagagatcttccaattcatttttaatatgttcaatgcctaaacggtgagccaatggtgtgtagatttcaagggtttctttcgcaatgcgttggcgtttatccggacgcaatgccccaagtgtttgcatattgtgagtacggtcagccagtttgattaacaccacacgaacatctttggtcatcgccaagatcatttttcggaagttttctacctgtgcttcttggcgggtacggaactttaatttatccagttttgatacgccctgcacaatttctgcggtgcttgtgccaaactctgcggcaagctgttcttcggtgtaaggtgtatcttcaattacatcgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcgccacttgaacggaattgcccctcgtgtgcatcacgagccacaacaaatgcccgcttcacaatatcaatttgatccgcaggtaaataaccttgaataatggtattaagactttcaaataactgcactttacacctcacacaacaaaaactgagatttcgtaatgtataacgaaaaatggacaatgaaaagggcaaattacccttttgattgtccatttttaacaaaatttgatctaattatgaatttgcttgcacatcagccaagaatgaaatagcttctttctctgccacttcttgcacgattgcatcaaatttctcttgttgatccataatttgattattaatcaaaccttcttcaatttcacgcaatgcgataactgttggtttatcgccctcttcagccacaagcggctcacgagtgtgaagttgaagctgtcttgcacggcgtgctgccgttaaaatcaaatcaaagcggttaccaattttctctactgcatcttgaacggttacacgagccattgtttactccaaattttgcaaaattctgaacttgtgaaagggtgaagattatacagaagttgtataaggctggcaatgatagagagggaaatctttatagagataatagctctatttgtaaataattttgctgtagttaaattttgtaaaagatataaactcatatagcctattttatctctcctcgctgttttctcattttagtgtatcttaggttatcggttttcattggaacgaaaattgtaggaatatcattgctccactattttcctctatcagataattggagagaaccatatttgtcatatcgaatcaaataaaagccccgattatatttcggggctgttaatctaaagaataattagaacttcgctaaaagcattgcttctaatttctcttggtcaatcgcaaatttacggataccttccgctaatttctcaactgccattggatcttggttatgttcccaatagaattcagcttctgtcattggtgctggacgagctttcacttcacctttgtactctaacttacgcactaaaggtgcttcgctttcttgtaactcttttaatagtgctggtgcaattgtcaagcggtcgcaaccggctaattctgtgatttcgcctgcgttacggaaacttgctcccattaccaccgtgttatagccgtgttgtttgtagtagttatagattgaagtcactgaaaccacacctggatcttctgctggtgcatactctttcttatcagaatttgctttgtaccagtcaagaatacgacctacgaatggcgaaattaagtaaacgccagcttctgcacaagcacgtgcttgagcctgagagaataatagcgttaagttacagttaattccttctttttctaattgctctgccgctttgataccctgccaagttgaagcaattttaattaagatacggtcgttgctgatccctgcttcgttatataacgcaatcagtttgcgagctttcgcgatagttttttccgtatcgtaagagtagcgagcatcgacttctgttgaaatacgacctttcaccacttttaaaatttctaaaccgatatttaccgctaatttatcttctgcatcgatcagttgttgtgccttatcattgcttttagcttttgcataagcaatcgcttcatcaattaatggagcatattgaggtagtgcagatgcacttaaaactaatgatgggtttgttgttgcatcttctggttgatacgctttgattgcatcaatatcaccagtatccgcaactacgacagtcatttgacgtaaagcatctagttggttcataaaaagttcctctataatataaaaaacaccgcctgtaataataacagtaactgcttaaagcacctagtatgaattaagtaacgagattatattttacaatatgttaactgggtactatttcttttcattccaaggtgctacccaaaacaagcataacattcctggaatcgctaagaaaaagcagatccaatagaaatggtagaagccaacgctctcagctaatgccccagatgtcgcaccaatcaatttacttggaatcgcggttaagctggtgaaaatcgcaaattgtgttgctgtataaagtggatttgtttcacgagaaatataggcgacaaaacaggctgtgcctaagccaattccgatatattcaccaataataaccgcagataaagcgaagcgttcgtaagtaccgattgtttcaaacttaccgtgacttgcaagccacgcaaagccgagtaacattagcatttggaacacaccgaaaatccataaagagcgatttacgccaatacgcaacatcagcacgccacccaccatgcccgccacaatagaagcccatagtccgttgatttttaccgctgtacctaaatcggtgcggctaaagcccatatccagaataaaggcactttgtaaggtagccgcaaaggagtcgcctaagttataaagcaatataaaagtgagtgtgccaaccgccggccataaacctttacgttgaaagaactctttgaatggaataacaaaggcttcgtggaaaggaagattgcggttatcttgtaaaattgttggctctttcgctaagaataaactcagaataatcccagggatcataaagagtgcggtaaacaaaaagactgtttcccaaggatagtggtcagaaacaatcaacgctaacccacctggaattaacccagcaatacgatagccgttaatatgaatagagttacctaaacccagttcttcatcagacaaaatttcacggcgataagcatcaaccacaatatcttgtaccgcagacacaaaggcaactgcaatggctaacatcattacgggtttaatatcttgtgctggattgaagaagccgaagcaagcaattaaccccaatagagctatctgcgtgaaaaacatccagctacggcgacgaccaaggaaatttgggtaatagcggtcaaacagtggagcaactaaaaatttccaagtgtaaggcaaaccaacgatagcaaaaaaaccaatggtttttaaatctacctgttcagagcgaagccacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgttcagagcgaagccacgctggaattaattgatagataaaatataacggcaagccagatgtaaaccctgtaaagacgcagagcaacattttgtaactgaaaatttgccgccaaagagaaacctgtacttgctcgctcattattaccccttatatccattcggattatttttttgccaattccaagtgtctttcatcatttgcgttaaatcgtattgcgttttccaacctagctgttcaagagctttttgtggattagagtaacagaccgcaatatcgccagggcgacgttcaaccaatttataaggcactttaatgtcgtttgcttgttcaaaggcgttcaccatatctaacacagaatagccagtgcctgtacctaaattatagacgtggaaacctgcatcatcttgatgtttttccaacgcttttaaatgcccaattgccagatcaacaacgtgaatataatcacgcacgccagtgccgtcgtgggtttcataatcacaaccaaacacagacagttgttgcaatttgcctacggcaacttggctgatataaggtaataagttatttggaataccgttaggatcttcgccaatcagaccgcttgcgtgagctccaacaggattgaagtagcgtagtacgactgcactaaattgtgggaaggctttcgctgtatcttctaggatacgctctaccatatattttgatgtgccataagggttggttgttccaccgacttcacaagcttccgtaatcggaatttctttcggatcgccataaaccgttgctgatgaactaaacacaatcgtattgacattggcttttaacatctcttcaaccaacacaatggaacctgtcacattgttttggtagtaacgcaacggctctcgaacactttcgcctacggcttttaagcccgcgaaatggataaccgaatcaatctgattttctgcgaaaatgcgacgtaacatttcacgatctaaaatatcgccttgataaaagcgaacggattttcctgtaatctgtttaactcgctctaaagagatttcagatgaattagataagttatctaacaccacaatctctttgccttgatttaataattctactacggtatgtgagccgatatagccagctccgcctgttactaaaattgccatatgttatccttgttatgaatttttgttgattatattctaatatagtacaaattttaattaaaatttaatgatttactgctctcaattttaattttttaaataagagcttcttttgaatattatctaaaattaaatattctccaggagccagagaacctagtttgaagtaactgactccaaccctaactaatcttaatgttggaaatccgatatgagcagtcattctccttacttggcgatttttaccctcaacaatttttagttcaatccatgaggtaggaatattttttctttctcgaattttgggggcactttgccatttaaaatgaggatctgggataattttaactttagctggctttgttaagccatcctttaatattacaccactagctaatctattaagatcttctggttgaggaatgccctcaatctgaacccaatatgttttttctttttcaaacttagggtttgctaaacgatgttgaatttgaccattattagtcagtaataatagaccttcgctatctttatctaaacgtccaataggatagacatttggaatagaaataaattctttcagggttttgcatgcctgattgttagtaaattgagataggaccccgtaaggtttattaactaaaacaactattgtttcatcaaaagtcagttttgcgttattaatacgttgtactggtctaattaaggcagatttgagtttaaacataatgatttttagaaaagttttagagaagttgctggattctatccatactaagctattaaaacaatagaaagctgagatccaattttatcacttgcgccgactaaactgcttcagtagaatgtcaactattattcttttattaatatctaatggggtcataacatgtttggaaaaggtggcttgggcggcttaatgaaacaagctcagcaaatgcaagagcgtatgcaaaaaatgcaagaagagatcgcacaattagaggtaactggcgaatcaggagctggcttggtgaaggtgacaattaatggggcgcataattgtcgtcgtatcgaaatcgatccatcgttaatggaagatgataaagaaatggcggaagatttagttgcagctgcattcaacgacgcggttcgccgtgctgatgaaatgcaaaaagagaaaatggcaagtgttactgcgggtatgcaattaccaccaggaatgaagttcccattctaattatctagttaatcactttaaaagtaggggcaaattgcccttgctactatttatatcatatcacttatgcaaagtagccctttacttgaaaatcttatggaagccctgcgtgtattgccaggggtcggtccaaaatctgcacaacgtatggcgtatcatcttttacagcgtaaccgctcaggcggtgtgaatttagctaaagcattgagcgaagcaatgactcacattggacattgcaaatcttgccgaacttttactgaagaagatgagtgtgctatctgccaaaactaccgccgccaaatcagcggacaactttgtgtggttgaaatgcctgcagatattcaagcgattgaacaaactgggcaattttcagggcgttattttgtattaatgggacatctatctcctttagatggaataggacctcgcgaaattggtttagatttattacaaaaacgcttagaagaagaatcttttcaagaagtgattctggcaaccaatccaacgattgagggggatgcgaccgcaaattatatcgctgagatgtgttctattcacaatattaaagttactcgtatcgcgcacggtattcctgtcggaagtgaattagaaatggttgacggaacaagcctttctcattcatttgtcggaagacgggatatttctttataaataatttcttactagcctatcaggacgttttgctgtaaactacgctcccgtcctgatggtttattccattccgaatttcaactctatttatcacataaaaggcagacaaaatggcaacgaattatattttcgtgacgggcggcgttgtttcttctttagggaaaggcattgcagcggcgtcgttagcatcaattcttgaagctcgtggcttaaatgtcactattatgaagctcgatccttatatcaatgtcgatccaggtacgatgagtccaacgcaacacggtgaagtatttgtgactcaagatggtgcagaaacggatttagacttaggtcactatgagcgttttatccgtaccaaaatgaccaaagcgaacaactttacaagcggtaggatctactcagaagttttgcgtaaagagcgtcgtggtgactatttaggtgcaacgatccaagttattccacatattacgaacgaaatcaaagcacgagtgattgaaggtggtaaaggtcacgatgttgcaatcgttgaagtgggtggcactgtaggcgatattgaatcactgccgttcttagaagcattacgtcaattagccgttgatgtggggcgtgaaaaaacattgtttatgcacttaacccttgtgccatatatcccaacggcaggtgaagtgaaaactaagccaacacagcactcagtgaaagagttgctctctatcggtattcaaccagatgtattgatctgccgttcggatcgtatgatcccagcaaatgaacgtgcgaaaatcgcgttattctgtaatgtgcctgagcgtgcggttatttctcttaaagatgttgattccatctaccgtattccagcgttattaaaatcgcaaggtttagacgatttcgtttgtgatcgctttcgcttaacttgcaaagaagcagatttatctgaatgggaacaagtgctgtaccaacaagcaaacccaacgggtgaggtgactatcggtatggtcggtaaatatgttgagttaccggatgcttacaaatcggtcaatgaagcattaaaacacgcaggcttgaaaaatcgtttaacggtaaacgttaaatatattgattcacaggatgtagaaaccaaaggcgtggaagtgttacaaggggttgatgcgattttagtccctggcggttttggctatcgtggtgtggaagggaaaatccgtaccgcacagtatgctcgtgaaaataaaattccatacttgggtatttgtttaggtatgcagattgcattaattgaatatgctcgtaatgttgcaggtttaactcaagcgaactcatcagaatttgataaacactgtccacaacctgtcgtgggtttaattaccgaatggcaagatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccgccaccgctatgaagtaaacaattcattacttccacaaattgaagcagcaggcttgaaagtgagcggtttatcggcagatcgtaaattagtcgaaattattgaagtaccaaaccacccttggtttatcgcagcacaattccatcctgaatttacctcaactcctcgtgatggacatccgttatttgaaggatttgtaaaagcggcaaaagagcatcaaggtaaaaatgcttaatgattttagggcatagtagacaaaatggttgctatgcccttttgtctactatgccgccaaattcccctctaaaagtcatttttctttcaacttttagagggaaaacaacagctagtataaaaccctagccctaatagttccatcaatctctttcaagcgttttaatgcctcgcccgtttgttctgtttcaacgtcgataaccacataaccaatcgtcggatcggtttgtagatattctgcggcaatattcacattcgcatcaacgaagactttattgatttgatttaaaatacctgggcggttttcgtggatatgcagtaaacgttttgtgcctttatgttctggcaaggaaacttctgggaaattgactgcagataatgtagaaccattatcggagtatttcacaaatttacttgatacttcagtgccaatattttcttgtgcttctgatgtagaaccaccaatgtgtggagttaagatcacattatcaaattcgcaaagtggcgactcaaacggatcgcttgcagaagctggctcttcagggaaaacatcaagggctgcaccacgcagtttgtccgtttttaatacctcaactagtgcatcaatatctaccaccgttcctcgtgccgcatttactaatactgcaccttctttcatctgggctaaacgttttgcatcaattaaattttttgttgaagcattctcaggaacgtgtaacgaaatcgcatcacaggttgaaagcagttcttcaagggttgcgacttgttgagcattcccaagcggtagtttattttcaatatcataaaaatacacttgcataccgatagactcggcaataatgcttagttgagaaccgatatgcccgtagccgataatccctagtttcttaccacgcacttcatttgaacctgcggcagatttattccaaatgccacgatgcactttcgcatttgcttttggcacttgacgcattaacacaatgatttcacctaacaccaattcggcaacggagcgagtatttgagaaaggagcattaaaaacagggatcccacggcgctttgctgcctctaaatcaacttgattggttccgatacaataacagccaatagcgaccaatttttgagcctgttgcaagacttcatctgttataaaagtacgcgaacggataccaacaaaatgagcatctttgatcgcatcaattagctcttgaccatcaagagcttttttatggtattcaatgttggtatagcctgcatttttcagaacatcaattgcattttgatgaacgccttccagcagtaaaaatttaattttagatttatctaaagaaactttggttgtcatattgccttccttatacagaagagagttgagtagcaacccccaaccctccgtagtgatttttcttattcaataatttttgcaccatcaagcgtacctacgatggtcacattcgcataacgttgtgcaaaaatcccgttagtaacaacgcctgcgatattattgatggtatgttccatttttaatggctcaaaaattttgaagttatacacatctaaaatcacattgccattatctgttacaacgctttcacggtattcgggcgatccccctaaggctactaattgacgagcaacataagaacgagccatcgggatcacctcaacaggcagagcgaaagtagagcctaacacatctacttgcttacttgcatcaacaatacagatgaatttttttgcaagtgaactcacaattttttcacgcgttaatgccgccccaccgcctttaatcatatagccttgcggagtaatttcatctgcaccgtcaatataaacatcaagctcagtcacctcattggcactaaatacttcaatgcctaacgctcttaaacgttcttctgaagcttttgaagctgcgactgcccctttgattttatctgccatttcacctaaggcatcaataaaacagtttacagttgagccacttcccacaccaacaatagtgtcaggtttaacatattgcaaagctgcacgagctgcaatttttttcatctcaagttgatccatagcgttctccttaaagcaaacgtttgcgttattatagtttaaaaaagaacaagcggtaagatccttacaaaattttgttgaaatcttaccgcttgcgattagttacgtttcaccgcttctgaaatctcttccgcacaactttgtgctaaagccccatcttcgcactccaccatcacacgaattagcggttctgtacctgatttacgcagtaagatacgacctttgccagctaaacgttgttcaacatcttttgcaacagctttaacttcatcactgtctaatggatttgcaccacctgcaaaacgaacattgatcaacacttgtgggaataacggcacagatttagccagatcatttaggcttaatttatgtgataccattgcagccaatacttcgagtgaggcgacaataccgtcaccagtagtatttttgtctaacacgataatatgccctgagttttcaccaccgagcttccagcctttttcttttaagacttcaagtacatagcggtcgcctacatttgctcgtgcaaacggaatagctaactcttttaaggcaagttcaaggctcatattgctcattaatgtaccaacgacaccgccgtgtaatttgcctgaacgtaatgcttcacgagcaataataaagagaatttggtcaccatcaaccttgttgcctaaatgatcgaccataattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcggtcaccgtcgccatcgtaagctaaaccgacatctgcaccagcttcgactaccacttgttgcaaggctttaatgtccgttgcaccgcatttctcattgatgttcaaaccatttgggtgtgtgccaatttcgatcacttctgcacctaactcacgcattacgtttggagcaatatggtaagttgcaccatttgcacaatccaccacgatcttataaccatctaggcttaaatgtgatgggaaagtacttttacaaaattcgatataacgtcctgctgcatcattaatacgacttgcacgacctaattcagctgaagccacgcaatccatcggctgatcaagcattgcttcaatcgcttcttcgacttcatctggtaatttttcaccgattgcagagaaaaatttgatcccattatcatcataagggttgtgagatgctgaaattacaatccctgcttctgcacgaaatgtacgagttaagtaggcaatcgcaggggttggcatcgggcctgtaaaggcggcggataaacctgccgctgccaagccagattcaagtgcagactcaagcatataacctgaaatacgagtatctttaccaatcaatacttgtttagagccttgagtagcaagcactttacctgctgcccaacccaatttcaatgcaaaatcaggcgtaatcggaaattgccctactttgccacgcactccatcggtgccaaaatatttacgttctgccataaataattaccttaaaaaatattgatatgctgggctatcattaacatcttgatagcgataacctaaccggtctaaatcttgtttaaatgcctctttttcactgccgttcacaacaaatgctgccaagatgtcaccataatctgcaccgtgagctcggtagtggaacagtgaaatatcccaatcaattaacgtttgtaagaacttcaacaacgcccctttctgctcagggaactcaaaactgtataattcttcttgctgaatagaacttgggcgaccgccgaccatataacgaatgtgggttttcgcgatgtcatcatcggataaatcggtaactggatagccattttgttgtaaatctttaatgatctctaatttttcagcattcccactaatacgcacgcccacaaagatacaggcttgctgatcgtctgcgtgacgatagttaaattctgtgaccgcacgattaccaataatttgacagaacttgagaaaagcgcctttttgttcaggaatagaaacggctaagagtgcttcgtgtttttcgccgatttcacaacgctctgacacataacgtagtgtgtggaagttaaggtttgcccccgataaaatacaggcgagatttttaccttcaagattgtgttgagccacatattttttcagtcccgctaaagataatgcccctgacggctctgccaccgcacgcacattctcaaacacatctttcaatgccgcacagatttcatcgttatcgactaacacaacatcatcaacatacttctgacacaaacggaatgtttcatcgccaatacgtttaaccgcaacaccatcagcaaataaccccacacgttctaaatcaactggttgccctgcttgcaaggcataaaatagacaagcggaatctttagactcaaccccaatgactttaatttcaggcatcaattgcttaatcagcacagcaatacccgcaatcaaaccaccgccaccgacaggaacaaaaatatagttcagatcggcattttgttgcaataattccataccaatagagccttgtcctgcaatcactagcgggtgatcgaacgggtgaacaaaggtcatattcagctcttgggaaagctcaatcgctttggctttggcttcatcaaaatttgctccatggagcaacacttccccaccaaaaccacgtacggcatcaactttgatcgacggcgtattttgtggcatcacaattaacgctcgcaaaccgagatgttttgcagacaaagcaaccccttgagcgtgattaccagcagaagccgcaatcactcctgcatttttctgagctggagagagattagaaatcatcgcataagccccacgcagtttaaaactatgcactggctggcgatcttcacgtttaatggaaatatgattacccaaacgctctgagagcttttccattttttgcaatggtgtaacttgggcaagatcgtagattttagaacttaaaatggcacggaggtaatccgtgcctgattgtaatggggtatcactcatcgttcaaccaacctttaattagtgattgcagccgcaaccgccgtgtccgtgatggtggtgatgatcgtgaccacagcaaccgtgatcttcttcatcgtgatcgtgaccacagcaaccaccttcttgatgaacgtgaccgtgagcaatttcttctaatgtcgcttcacgagttgcaaccacttccacagagaataataattcttgacctgctaacatatggttaccatcaacaacgacttcgtcgccatcaacttcagtgatcaccacaggtaatggacctaaatccgtatctgcgataaaacgcatacccacttctaattcatcaacgcccataaacacatcttttggcacacgttgcaccatattttcattatattcgccgtacgcttcttctggtttaacacgcacttcaaaagtatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaccgctttaccttctaacgcattttctaaaccgataacaagattgttgtgaccgtgtaaatattctaatggttgctcaactggtgcttcatcaactaatacgccatcttgagtacgaacttggtatgcaatgctaggcacaacatttttggtaattttcatttaagtatccttattttattgggtaaaaagttctaggcattgtagcttgttatagaggatttgcaaatgttagtaacaaaatgaccgcttattcttacaagcggtcaaattttgaaattaatccacaatatcaggtgtcaccgcatcaaccacatcaacggcagttccaacaacaccaccaacaacagaagtgactaaacagccacttaccgaagtgcaaagtaaagtaagaccgagtaacttaatccatttcttcatttcaagcccttacttttcaaatttcacctgccccgaagcaaacgcagaaatagtggctttgcctgtctcaagtggaatatccacatctgcctctttcgcataacttgcggctcttagtgcgattggacggctatgatgttcctgtccgttaggggtttctaactgaacattactaataatataacgtttcgcatttagccctttttgaataacttcggctttgcgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactgagcaataatgtctaacgtcatttcatcttcaagagaagctaatttttcaggcgacacactaaaatgaatttgaccaatcgccacatcatcgcctaaattctcaagcacctttgccatagcgtcaaaatttttacttttcaactgaatgcgaccttctgcgaaccagcctgtcaccttacctttattatcgtattctggatagttactaatgccatctgtagataactcaatgcttttatcttgtttcgctaattcaatcacctgattgagatgagcagaaacttgctttttcagttcattcaggtttttacctgacattctgctatatacctcagctttcatcagatctttatccaccgcacgacttacttgcgttgaaaactggaaagtcgagttggtatcaaaggtatttggctctgccgatacagccaatgaggtaaatacaagcggtaaaatggctaaatattttttcaatgtcattctctattccttttatatcagggcgtaaaacaccacttagaacgtatttctcttgattagttcaatgtttaaaatatgtgcaagatcctgtcgcaccttatctatctgccaagtcacgttatagccagccaagtgcataccataaattcgctcacttggtttactttgctgatatgcgggtcgagggtcttgtgcaaccacatcacataaaaattgcacaggatcttcaatgccaaatttcgcaaagttctgacaagatttgaccgcttgtagtgcttgctcagtcaaaagcacttgcaatttcacctcaggtttatcttgagcaaaccccgataacgcattcggttcactatcagcataagcaacgtaaggtttaatatccaaaatcggtgtaccatcgactaaatcaacactgcctaaatgtaaataaacctcgccctctttaacttcaatacgatctaatgccaccttcgataaacctaacggatttgggcgatgtgtcgcacggctggcaaatacaccaacacgctcattcccacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccacccaaacggggagggcgaacagtagcgtgccactctcgttcaggaatttgatgaaattgaaaaataagccaaagatggctaaattgctccaaacctcgtactgcatcaggcgtattataaggtggcaacaaacgcaaaatacctcgcccttcacggactaaattgggctgacgaggaacggcaaatttttccccataaggtgtttgtatcgttccaatgggagaaagggttaaagaggacggatttgtcataaaaaggcaaattttctgttaaaaatcaaaacatataagaacattttgtaataaaatacacagttttaaaagaaaaacttcattaaagtgactaatttattgatatgaataaaggttctatgttctctatttggctttcaacggctcgcccaaaaaccttaccgcttgcattagcgtctattctaatcggctcggctttagcggcttggcaaggaaaatttgattggctaactaccttacttgcttttatcacaacgattttgttacaaattttatctaactttgccaatgattacggcgatcacatcaaaggttcagatacttcagaacgaatagggcctttacgtgcaattcaacacggggcaattacgggggaacagcttaaaaaggccttaatctttgttgcgatactctctttcatctcaggctgtggattaattggttatgcttatcaaagttggcaagatcttattgtttttgcactacttggcattttagcgattgtcgcagcaattacttacaccgtaggaaagaaaccttatggctatttaggattaggcgatatttccgtactcattttctttggatttttagctgttttaggtacattctacttacaagtccataccctacagtttgatctattacttcccgctttcggctgtggtctattatctgtggcagtattaaatatcaataacttacgcgatattgagcaagataaacaagcgggtaaaaatacccttattgtccgtatcggtagccagaatggacgccgttatcatcttcttttactcagtttagctgtactatcctatcttttattcactctgacgaattttgctcattggtacaatttcctatacttattagcaatccctttactagtcaaacacggtttatttgtttaccgccacaaacacccaacagaacttcgtcctatccttggacaaatggcagggttggcattgataacaaatttgctgtttgggttgagtatcatgttataaatctgggattaactggcttacagtttgtatatctttatagcttctccgctttctctggcaacaacacaggaatgccattttcaatcggataataaacattcgccgaacggctaattaaacggttgttttctttatcccactctaatttggtctgagtgattgggcaagcgatcgtattaagcagtttttcgttcattctgttttctcactaattcaaggacgggttctaataaacaagcggtatcttgtgctgaaaattttgcagaaacaggcacataccaccaatttggttgagcaaaactacggcattttaccgcatctttttcggtcattaatagcggtaagccgtctttctgtaaaggttcgattatgtttaacgcgtaaggttgatgatcagcaaagccataactttctttaagttgaatgccaagctcttgcaacatcataaaaaaacgagacggatagccaatgcctgcaagggcaatcgccgactgatgataaaaatcggttatcggttttttctcgcctgtttttaaattgattacccattcaggttctaactgcattagatgttcgcctgcttgtgcagattttccgttgcaaatcaccgcttgcaccgaatttaaacggcttggaagctctctcaagccacctgctggcaggacaaaaccgttaccaaaacgacgctcaccatcgacaacaacccactccatatctcgttcaagggcgtaatgttgtaagccatcatcagtgataatgagatccaactcaaattggctcaataatagctcaatgctctgtcggcggttcggcgaaattgccacaggagcgagtgtccgttgagcaatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttttgccatttccgccaacagaaatatttcccaccactaagactggcactggcgagcggtaagatgttaggatttttttgcggtataacaccactcgaatttggctaatcaaccaaaaaagcagagagagtggggctagtagccaagtgatgagggattttgtttgccagatgttcatagttgttatacgtaaagtcatttatatgtttctatgatgtactggccattctatggcatcaaataagtaatgtctaaaaaataaattatttttgtaagcataggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaaaagtagttgattccagcatagcatgactataaaataaaataataatcattattaacttgtgcataacaacatgaactcttatagacagcaaatcacccagcttcttgctgaaaacccgaatatgattacccttgaaattgcggaaaaattagctctcccagaagggcaagtgctttgcaatttaccgagtgaatttgtccgcttgttctctgcagatagagcggaagagattctacaagcgatcagtcaatggggaacatttacaactatcatcgaaaaagaaggttccatttttgaaattaaagaccgttttccaagcgggatctttgctcgaggttattacaatttgaatatgaaggatcaagaaggcacacttcacgggcatttaaagcttgataatattgctcgaattgcctttgttagcttgccgtttaaagggaaagaaagctacaacattgcttttattgcacataacgggcaaaccatttttaaagtgtatctcggtcgagatgagcagcggcaactcttcccaacacaagttgaaaaatttaagacatttcaataaaaaggagcgataaatgtcaaatcgtcaagaagtattacaaaaccgtttagggccagaaattcaagaatttaaagcaaaaatgaaaacattggtgcttgccactgtggataaagagggaacccctaatgtaagttatgcaccatttgtgatcaataatggtgaatatcaagtattgatttccaccattgcccgccacgcatgcaacctacaggaagtgccgaaagtgtcgttaatgttgttggaagatgaaagtcagagccgtgaaatttttgctcgccgccgtttgaccttcgacgcaaccgctcgcattgttgaacgccatagtgaagagtggaatgatggcattgccaaattaaaagcccgtcacggtgatttagttgatgagttagcaaccttacaagacttcaagctgttctgctttaaaccacaacaaggattatttgtaaaagggtttggtaaagcgttccaagtaagtgctgatgaattagtgaattttgttcatcttgatgaaggacataataaagaaatcggtccgcacgagaaagaggcataaaacacaagcggtcagttacagtaaatcctttaccataactgaccgcttgtctattgatggaaactactcagcgtcttctttcgcccattctaatgaacgtttaaccgcacgtttccaacctttgtagcgttttgcacgtttttcttcatcgctgtcaggtgagaaggttctttcgatttctgctttaccacgtaactcttccaagctgctccagaaacctgtcgccaagcctgcaaggtaagcggctccaagtgcggttacttctagcactctcggacgttctactttggcattgagaatatctgcttggaactgcattaagaagttgttcgcaactgcaccgccatctacacgtaaagttgctaatttcgcaccgctatccgcttgcattgcgtctaacacttcacgggtttggtaagcgatagattctaatgttgcacgcacaatgtggttacggtttgcaccacgagataagcccacgatagcaccacgctcataaggatcccaatatggcgcacctaagcctgtaaacgcaggaacaacatatacgccatttgtactgcttactttcgttgcaaagtactctgagtcacgagcgtcgtggataattttgagttcatcacgcaaccattgaattgaggcaccagccataaagattgaaccttctaaggcatagcaaggttcacctttggcgttacacgcaatggtggttaataagccgtttttcgattcaaccgcttgatcgccagtgttcatcaacataaagcagcctgtgccgtaagtattttttgcttgaccagattcgacacaaagatgtccgtaaagtgccgcttgttggtcacctgcaattcctgcaacaggaatacgcacgccatccataccaccaatgttggtttgtccgtagatttcagatgagtttttcacttcaggcaacatttcgcgtggaatatctaatagttccaacattttgtcgtcccactgtttggcatgaatgttgaataacatcgtacgagaagcattggtatagtcggtaacgtggcttcttccttgagtcaatttccatactaaccaagtatcgaccgtaccgaatagtaattcaccttttttcgcacgttctcttgcaccctctacgttatccaaaatccatttcacttttgtgcctgagaagtacgggtctaccactaaacctgttgttttacgaatatagtcagcgtgaccttcagcttttaatttttcgcagaaatcagatgtacggcgacattgccatacaatcgcattgtaaatcggtttacctgtttctttttcccaaacaatcgtggtttcacgttggttggtaataccaatcgccgcaatttcatcggcttttacccctgcttttgcaacaacttcatttaaagttgaactctgacttgcccaaatttccatcgggttatgttcaacccaacccgcttgcggataaatttgagtaaattcacgttgtgccacttcaacaatgtttgcatttttgtctaataacaccgcacgagagctggttgtgccttgatctaaggcaatgatgtattctttagtcataggatcacctctgaaaattatttaagattacatggtaaatttttaccaataacacgggtatagataaagccacctaataaagccccaacaatagggccaaaaataggtactaggaaataaggaatatcacgtccgccagtgagcgctatatctccccaaccagctaagaatgcaaagagttttgggccaaaatcacgagcagggttcatcgcaaagccagttaatggccccattgcaccaccaatagtcgcaatgagtaaaccgataagtaaaggagccattgcacctcttggtaaaccgttaccatcatccgttaaagcaaaaattaatgccattaatacggcggtaatcaccacttcaacaaagaaggcttgtaatacgctgatatgtggattaggataggtcgagaaaacacctgcaaagccgacaccttcaccacgcacaatattttgtgccgcttcactggcagcaaaaagatctttatataagaagtacactaatgctgccgcacagaaagcaccgagcatttgagaaataatgtaaggcagaattttttgccatcaaaacaagcgaatttccataacgcaatagtaacagcagggtttaagtgagcaccagataaccccgcagaagcataaacagccattgcgaccgcaagtccccacacgattgaaatttcccacaagccgaatgtggctccagcaacctgtgctgcggcaacacagcctgccccaaaaaagataatcaaacctgtaccaataaattcaccaatacaagcagcttttaatgatttgtccataaattccccctaaggaaattaaattagaaagtaaaaatgtttgaaaacgagagttttcgagggtgagatataaaaaaagaacactttacgcaaacaattaaataaaaatttgtgaagttgctcacaatttttttaaaaaagaaagtgatttttgtgaaatgttaatatgtatcccaaatacgttacaaactttatagccgttttgttagataaaaataagcatatttcattaatctcaactgtcgtttccagcgagtaggctgatgtaaaatacgaaacaaccactccaaacctaaattttgccaacatttaggagctcgcttaaccttaccgacaaagacatcataagtgcctcctacccccatatatagtgcatcaggataaagttgctgagctttttgcataaatttttcttgttttggcgagcccatcgccacggaaataaatttcgcaccactcgcttttattctctggataatttcttcttcctgctctttagcgaaataaccattttgtgttccaaccacttttacttgccattcctgcaatttcattgctgttgcttgtaaggtatcctctgagcttccaactaagaaaacaggtaaacagcattctcccaactcagccatcaacctctcccacaaatcagcgcctgcaatgcgttcaattttcgaatacttcggatatttagatctgatagtacaaactacacttattccatcggcatatttatattcagcctcctctaatagccttttcatttcattatcttcttgataaatcataattttttcagcatttattgctatcaatttacctgttagaagaactccattattcaataaataggctaccaaagtttgctgattttcaacggctaataactcaactccaccaactgatactttattcatacccctctctcaccctatttatcaaataggctactatataagcaaatacaaaaatcacactaaagaagcagaaccgtgaaataaaagcatctataccttctcgtatcaatacaatcaaattgaacaaatttgccaaacaataactttgaataactgccgaattttttccataggcaaaaaaattatcaaagatacgtattaaaccaccaaccaccgccattcctatagcaatcattggtatcccccccataatataaaaagagcctaataacgttggcgacatagctaaaccagaaaagttacctaatacacttttcgtgaaatagtttgctgtattccacacaatgtcaggtcgtgcctcccataatgattgaggaatatacacataaaaatcacgcacgataggcattaatccttgaaactcaatctctgcatccattatttttgctacattttcccaaggcgaaaaggtatcacgtgtcaaataaagaaaagtgtaaaatgcttccgaaccttgtacattaagccgataccgccataatgccaacaaaaacattgcaataactgtcaaaagccctgccctcaccagccatttaaatgataaaaacctccgcaaataccccaacagcataaacataacaaaggctaatgcaaggttagctcgtgtgcccccaacggctaggtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaacaccccaaatgtcattccagctaccaaaaatagccaccaactttctttagtaggctttaagaaaaaccaaattaacaaggcgggtaaaaagaaataaaagaaacgttttaaagccacgccactaacttgtgcagaaaaaatgtggctatatttttctaatttgaataacaatagcccttgatttaacaacataaatcctaataggctcagtattgcaatcatcattaaaatccaagcggtcagattagctagcgattttacctccaccgcataccttggtatttgcttatttctccctatataaagataactcacgtaatagataagatagctgcctaaagctattgctagtacgttccacaacattgagacggctggaaggcgatattcaaatagctctgccatcgtcatcgaaaaaggaaacccaccgaaaaaggtaataagatagatgccactaaacagcaaatggaatgaaaagccttgctggcgataatctcgttgaattatccaaaccaacacacttatagcgattacataaaaaaggattaatcccgctaacatgttaatgttccttaaacaaggtgggtaatttttactgaaattataccgcttgtaaactaagagaatgtaaacagttcagccattcttgcttataacttagagggaaaaaagtaattttacttttatcaagtaaagccaactgggatttaactcgtataatctctgaattactgatttcatctgcgaaaagaaagctaattccctccgcttgtaaatcttgttgaaaaggatttgctctgtgaatgaccatcggaatattcatctgtatgagtaaacacatcgttccgatcccttgctgacgctcaaaaggaaagtaaccaagatcacattgagacagtagatccagataagcctcaaattctaatttctgagtgataatgtccacctgcccttgttggaagtattgttctgcttgttggcgaacttgagcaatatattttgaattacctgcaggataccccatcggcacgactattcgtacattttcgccaaatatctctcgaatttgctttaatcccagtaaatgttgattgcttggatcgccagaatttcctaacaaaattatccgttgaggagaacattttttagccggaaaattcgtaggcattctagttggaaaatagagccgttgatccagagagctcttacgttttaattgttgataagcgtgatttaaatctcctaaagttccccacaagcgtgctattttacgttgtgcaagtcttcgcaatggataaaacaatctaaactttaaagaagaagagagctcataaagatctgctccccaaatatgccaaacacaacgatttgctgggactaatcctaacaatatagctaaccacaacgatgcattgaattgcccatgtaacacaaaccaagcggttggttcctttcttgcaattttgataacttcttgagtgagtaaatattcatctggatatgaattaatatctaataatgtaaaagtttcagacaaatcactacgactaacaacataaaaatgaaaagcattcggtagttcatccaataattcattttgaaagaaatttagtattgtgtgattgtgatggggaatattagcccctaaaacatggattatatttgccatattccatctataccatattaaaaagaatagtcttgatgtgacatataaatcactatttaaatgttgccaagtgttcctacgatatttaatcctttgacccatgctttaatattcatttcacattaatgacattatctataatttttggtaaatatattgagcaacaatagagaaatatacgtgagatttgaaaattttcctgtaaaattttacctcataagttgaataattatagccagccataatgttaaatacaaaagaaaaacagaaagaacccgtagcgaaaaagccctactttatcccaacttgcttaaaactagctctcttagccacttgctatgttgggatatacggcatctatttagatggaaaaattcgttctaaaatggacgggcaaatttggcaattgcctgccgaggtctatagtcgtatcgaaagtgttcgccttgatgacaatcttacccttgagcaagtcaaactcgccttgttagacaatggctatcgtgaagtttcattaattgcaacaccaggtgatttcaaaattgaaggtgacaatcttgttttgcttcgccgtgctttttctttccctgaaaatcctgaagcccaacgtgtactgcgtttacgctttgtcagtgataaactcgctcgtattgaagatttagtgcaatttaaagaggtcgaggaatttcgtcttgaccctaaaatgattgcaatgttgcattcggataacgatgaagaacgtcaagcgttacgtttgcaggattatcctcgtctgcttattgatgcgttgctacttaccgaagataagcgtttctatcaacacgaaggaattagtccactggggattgctcgagcctttttgacaaactatcaagcaggcagaacagtgcaagggggcagtactttaactcagcaattagttaaaaacctctttctaagtaatgaaaaaaccttagtgcgtaaagtaaatgaagcgttaatgtcgctgattttagattttcgttacgataaaaaccgcattctcgaaacctatctaaatgaaatttatcttggtcaaaatggtagttatcaaattcacggttttgctctggcaagtcaattctattttggtcgtcctattcaagaaattaatctaaatcaaatcgctctgctagtgggaatggtgaaaggtccgtccctctataatccgtggaaaaatccagaaggggcattagaacgccgtaatgttgtgttgcgtgtattgctagaacataaggtgattaatcaagaattgtataatttacttagtaaacaaccgcttggcgtgaaagagaaagggaatatctatcgtcagcaacctgcgtttatgcacgccttaaatttagatattaaaagtcagttgggtgagaacaaatctgctctgctgtcaggggcaaaaattttcacgactttagatagaaaacaacagcgttctgcggaaatggcggttatcaatggggtatccgaattagaaaatagcagtaagaaaatcaaagagttgcaatctgctattgtggtggcggaatataaaacgggtaaagtacgggcgattgttgggggagttcagacacaatatgctggttttaaccgtgctattcaaaccaaacgtcaaatcggttcattggttaaaccgtctatttatgccattgctttggcaaatccgcagtatttccgtcttaacacgccgatagctaaccaaccgattaccattaccgttggaagtaatacttggacacctcgtaactatgatcgtcgttttagcggttctgtgatgttaatggacgctttagttcgttcccttaacattcctacggtaaacattggaatgaaacttgggctgaaaaatgtgattgccaagcagaaagaaatgggctgggataatgccgaaattccgccttatcctgcgacattgctcggctcttattctatttcaccttatgatgtcacgaagtcttatcaggttattgcaaatgctggcttaaaagtaccgcttacaacaattgaagcgatcatatccccaacaggtgaaataatttatcagcctgttctcacgcagacaagtaaacgcgttttgcctgcagaagccacaattcaaacactttatgcaatgcaacaagtgacggagcgaggtacagctcatagcctacaggcagattttgcacaactgcatatcgcaggcaaaaccggcaccaccaacaatgcacgagatacttggtttgtcggcatagacggtgaaaatgtcacgaccgtttggttaggtaaagataacaatagcgatacctatctcaccagttcaagcggtgcgttgcaaatatataaagagtaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaacgtgccgaacccttggcgttcaagctaccaagcataccaactattcaatgggtaggtatcaacagctacggctcttgggactgctccagccctcgtcaaattcctgtttggaaagataaaggacaacgctattgtacgggtggcggttctatggttgaagcaaaaccaagtgtgtgggacgcattgtcgctaggcaaagacgcacctcaaacccaaccaaataaagccgacgaagcagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaagctccgattgaggaagaaccattagaggaatagattaagaacggcatagtagacaaaaattacgggcaaagggtcattaattttcatctactctgccatatctttcaattcttacgccttttccgcctctaatctttcaaaagaaagcactttgcgttcaactctgcgtaagattacggtcataatccctgtaataaccaaataaaccgcacctgctaaaccatagatggttaatgcgtcatactcagttccataaagctggcgagcatagcccataatatccataatggtaatggttgaagccagtgatgttcctttgaacaccaagataatctcattgctgtaagacggtaatgcccgttttaacgcataaggaacaaggattttcaatgtctgtaatcgacttaatcctaatgccgcacaggtttcccattgcccttttggtatcgctttgactgcaccgtgaaatagtaaggtggtataagcggcactatttaaagcaagggttagcattgcacagaaccacgcatccgataacaaagaccaaaatggacttgcgacaatccaaggaaactgcccaggacctgcataaatcaagaaaaactgtactaacaatggcgttccagtaaatagggttaaaaagccatttactattccttttactagacgattttccattgaaagtaaaaacgtcattccaacagcaaggaaaaatgccacgattaaagaaacaaacgtcagcaataaactagtcgggataccctgagctatcaccataaagtattcttgcaacattatttaccccctctttcaaaacgagtgaagcgtagctctaatttacgaataattacttggctgactaaggttacaccaaggtaaattaatgctgctgtaccgtaccaagtaaatggctgatgagtgctggtgttaattaactccgtttgtcgcataatatcgtgtacaccgattaaagaaaccaaagcggtatcttttaataacactaaccactgattgcttaaccctggtaaggcgtgtcgccaaacctgtggcatcacaatgtttacaaaagtatagccacgacttaatccaagagctgccccagactcccactgcccaagcggaatagcttgaatagctccacgcaatgattgagaagcgtaggaagcaaaaataatagatagtgccacgacaccacagccaaatgcaccgagttcgacatattcccctgtgatcatttcaagcacttcaggcgcaccaaaatagattaaaaagaccactaaaatttcaggcaaaccacgcaataacgcaacaacaactgtggttggtttacgcaccattgtccatttatgcgtttcaagcaccacaaaaagaatggacaatagtaatccgagcaataaagagcaaactgccaaccctaaggtcattagggttgcagaatacaatagaggaagataatccaaaaacataatgattatttagtcatccatttatcataaattttttggtactcaccgcttgctttaatcgctgcgatacctttgtttaatttttcaactaactcagtgttagattttttcactgcaatgcctaagccattgttgaaataacgtttatctgtcactttctcgccaacaaattgtgcttcagggattttgcctaacatatctcttaacacatcagtgtcaccaaagattaaatcaatacgaccattttttaagtctaagattgcatcttgtaaactcgcataagattttgcttgatattgtttagcttctgccgttgcgtattgttggtaagttgtaccgttttgtacacctactgttttagcagatgctaaatctttaccttgtaaagcaatatagcttgctgaactttcgtagtatggtgctgagaaagccacttgttttgcacgagcttctgtaatatcaatcgcagaaattgccgcatcaaaaccgccacgacctttaattaagctagggattaacgaatcaaacgattgagatttaaattcacaagtcgcttggacttctttacagattgcattggcaatatccacatcaaaaccaacgatttcacctttctcattagtttgctcaaatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaccaagattagtttgctcaaatggcggatagcttggctccattgcaaaagtaattttatcattcgcataagctgaaactgcagttgcggctaaaacggttgctaaaagtaattttttcatagtaactcctattaattgtatgatgttgtgattaatctgaatgtgaaagatattgagcaaattgcgttgtttttggttgttcaaaacagcttgcatcgcccatttcaataattttgccttgttccatatacaccactttagtggcaactttacgagcaacagaaacttcgtgtgtcacaatcacttgggtgatccctgtttgttgtaactctttaataatatcaaccacttgagcggtaatttcagggtctaaggccgccgttggttcatcaaacagcaatacttccggttgcatcattaaagcccttgcaatcgccacacgctgctgctgaccgcctgaaagctgtaacggaaaacgctctgcaaatgcagtaagttgcaaacgtgctaacaaacctttggctctttctaccgcttgctctttcgttaaacctaatactttcattggtgcttcaatcaagttttgcattactgttagatgtggccataaatgatattgctggaacaccattcccacttctttacgtaataatgcaacctgtttcgcattggttttagcggtcagatcaaacttatgatttgcaatctcaagctgacctgattgcggtacttccattaaatttaaagtacggattaaagtacttttccctgctccactagggccgagtaacacaacggtatcgcctttttcaatgtttacattaatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaaggcttggctcgaaccgtaaaagaaattgacattactaatgcgaattgccattaactacttcctatcaaagttttaaaactgaatagatattaaattttattgcataactatgcaagtgatttttgtaaatttgaggtaaaaattttgatgaaaaaattaaaatacatatctgtaattgtaggttataataatcacactgtataaaatcacataaagaggcggagatggatttttctttattacttgacggcttaaacgataaacaacgagaagcggtagcagcccctattggcaactatttagtgttagcaggtgcaggtagtgggaaaacccgtgtgcttacccaccgtattgcgtggttaattggcgttgaaaatatcgctgagtccaatattcttgctgtgaccttcaccaataaagccgcagcggaaatgcgtcatcgtattgaatataccctatcgcaatctagcgaccaccgcttattcggtatgtgggtcggtacattccatagcattgctaaccgcttacttcgctctcattatcttgatgccaatctgccgcaagattttcagattatggatacggaagatcagcaacgtttgattaaacgcttactcaaattgcataatttagatgaaaagcagtttccaccgaaacaagtggcgtggtttatcaatgctcaaaaagatcaggggctaagagcaaaagatctcaaacaatctcacgatgatccccattcacaacagctcgttaaattctatcaaatctatcaagaggcttgtgatcgtgcagggttgttggactttgcagaactcttaatccgtgcttatgaattatttaagcataacccattgattttacaacgttatcaacaacgttttcagcatattctgatcgatgaatttcaggataccaataacattcaatacgatcttattcatttattagctggaaaaacgggcaaagtaatgatcgtgggcgatgacgaccaatctatttacggctggcgtggcgctcaagtggaaaacattcaacgcttcttaaatgattatgacaacgcacaaactattcgccttgaacaaaattaccgttcaacaggacatattttaaattcggcaaatgctttaatttcaaacaatgacaatcgtttaggcaaaaatctttggacagataaaggtgacggcgatcccgttgatatttattgtgcattcaatgagttagatgaagctcgctttgtcgcttcacagattaagcaatggaaagaagatgaaggcgattttaatcaatgtgctgtactttatcggggtaatgcccagtcccgtgttatcgaagaagccctaattcaagccaatatcccttatcgaatttatggcggaatgcggttctttgaacgccaagagatcaaagatgccctagcctatttacgtttaatcgctaaccgccaagatgatgctgcctttgaacgtgtggtcaatacaccgccaagagcaataggggatcgcaccttagatattttgcgtcagcttactcgaactcgccaaatcaccttgtggcaagcaatccaagtggctgttcaagaagaacatctttcggggcgttccgcctcagccttgcttcgctttgtcgaactgattaacgcacttgaacaagaaaccgaagaaatgccactgtttgaacagacggattttgtgattaaaaaatctgggctttatgaaatgtataagcaagaaaaaggggaaaaaggcgaagttcgtattgagaacttagaggagttagtgactgcaacacgccaatttgtaaaaccagatgaagcagaagagatgaccgatctcaccgctttcttaactcacgcctcccttgaagctggcgaaacacaggcttcactacatcaagattatgtggaattaatgacattacattcagccaaaggcttagaatttccacgggtgtttatcgttggggttgaagaagggattttcccaagtggaatgagcttcgacgaaggtcgcttgcaagaagaacgtcgcttggcttatgtcggtattacacgagcgaagaaaaaactcacgatcagctatgccgaaagtcgccgcttgtacggcaaagaagaacgccatttaccgtcacgttttattggcgagctgcctgaagagcatatccgagaagtccgcctgcgtggaagtatcaatcgccctgctacttttgcaaaaccacaagctaatccgaccgctcgtttacaagaagatagtggttggaaaatggggcagaaagttcgccacgagaaatttgggcaaggaacaatcatcaatgtggaaggcagcggtgatcatactcgcctgcaaattgcctttgtacaacaagggattaagtggttaattgccaaagtggcgaagttggaaaagatgtaaaaaaatccccaaccaaatggctggggattttttactttaatcgtaaattactcagaaactacgttgatagttactactgcatttacttcagcgtgtaagtgtaatttcacttcgtgttcgccgatagtacgtaatgcaccttctggtaaacgaacttctgatttagttactgctacgcctgctgctgatactgcttcagcgatatcacgtgcaccaacagaaccgaataaacgaccgtcatcacctgctttagaagtgattacgattgctgctaagttagcgattgctgctgcacgagcttgtgctgcagataatgcttctgctgctttcgcttctaattctgcacggcgtgcttcaaagtgagcaatgtttgctgcagttgccataactgctttaccttgtgggattaagtagttacgagcaaaacctgctttaacagttacttggtcaccaacggtaccaagttgagcaactttgtctaataaaataacttgcattgtactcttcctctcttattactgatggttgtcagtgtatggaagtaacgcaaggtagcgagcgcgtttgattgcacgagctaattgacgttgatacttcgcacgagtacctgtgatacggcttggaacaattttgccgctttctgaaatatagttctttaatgtagcgatatctttgtaatcgatttcaacaacattttccgctgtgaaacggcagaacttacgacgacggaaataacgtgccattttggcttctcctaatctataaattcaatctgttcggtgtgtaagactaactgatttaaatcattgtagtctttgtgagtatggataaatccttttactcgaacttttccaccgaccttcatttgttgggttattaaactaaattgattgcctgccaaaatcacttggattttgcaccacgcttggcgttctaaattgacttctttttgcactgaacgatgttctaggtaaaaagagtaagttggaatacctatcgggcttaggctttgtttaatcgttgttgcgatagtgccacttaagattaaacagttatcaatagacgaattactcgtctgcatcctcagcttcaacttcttctactaaagcttctggagctttacgctcatcttttgctttaagcattggtgatgcttctgttaccgctgctttagtgtgtaacactaagctacgaagaactgcatcgttgtaacggaagttagtttctaactcatcgattacgttttgtggagcttctacattcattaacacatagtgtgctttgtgaagtttgttgattgggtatgctaattgacgacgaccccaatcttctaagcgatgaacttgaccgcctgcttctttaacagaagcggtataacgctcgatcataccaggtacttgttcgctttggtccgggtgaaccataaaaacgatttcgtagtgacgcattgtcgatccttacgggttaacagcctccaaggttgccagtcaccagcgttggaagcaaggattaaaaacaggtgtgactgaagccgtgcattatacggataaataaaattcgtacaagtaaaagttaatctgcatagcaaaattaggcataaatctatctgcttatggtggtttttagcattagatattaaaaaatttttatccttttttagcatggtaaaaacagaataaaaaactaatttatctaaaatataagaataatgttcttgttatagtgctttaattggcgtttatgagtggttgtatagattttaatactaaaaatagggttgttttattggttttggcgtgttaatttacactctctttttttcggaaacctttggatttttgacaatgacaactcatactctaagaaataatccacgcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggcgattgcagcaatgatcgggactgcaattgaattttttgactactacatttatgcggcagcagctgtattagtatttaacacccaattctttaacagcgatgaccctgtttcaaatgaattactttccctttctacattagcactagcattcttcgctcgcccaatcggttcggcacttttcggacattttggggacaaaatcggacgtaagaaaacccttgttgcttcattattattaatgggcggttcaacggttactatcggcttattaccaaactatgaaagcattggtatctgggcaactattttgctctgcttatgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaaacgtgcttggtacggtacattccctcaattaggtgcgccaatcggcttattcttagcgaactcatcattcttcttagtcagctacattttcggtgctgaagccttagtagaatgggcgtggcgtattccgtttgtttcatctatcgtacttgttgccgtaggtttatatgtacgtcttagcttacacgaaagccacgtttttagagaagctgaagctcaaggcaaaaaacacgcagcacctgtaagcaaagtatttaaagaccacttaaaaccgttgatcattggtacattcattatgacagcgacctatgtgttgttctacattatgactgcctttgctcaaatttactcaaaaagtgcaccaacgctatcaccagcaggacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatgggcctaggtattccagctaacacatttacaggattactcttattaagtgcaattgtatttggtatcttcgttagcctgtcagggatttttgctgacaaaatcggtcgccgtaaatggttaatctatgtgacaacaggtatcggcattttcggtttattaatgcctttcttcttaggaaacggtacaccaatgagtgtatttgcattcttagtagttggtatgatttttatgggaatgacctttggtccaatggcggcattattaccagaattatttccaacagaagtacgttattccggtgcatcacttgcctataacttagcatctattgtaggtgcaaccattgccgcaactttcgcaattaaaattaatgcggcttatggcttaatcggtgtggggatctaccttgcaattaacgcagttatcacattgattgcactctttgcgtcaaaagaaacgaagaatttggatttgactgaagtgtaaatgctacgaattgtaagttcatttttaagtttgaaaaatagtatcaaaaaagtggcttaatctaaaccacaacctattcaacttctcaatttcaggctgatattccaccattttggcaacacaagcggtgggatcaaagcctgatttggcaaaataacgtgctaagaaaaacgccttttgttccgcagacaaaggattgttatgaaaaagcaacgctaattccaaggcaggatcggagatcgctgcatattcccaatcaatcaaaaagagtttttcatcttgttcgactaaatttgcaagatgaatgtcgtgatggcaaatggcttgttgataggggctaatttgctgaaaagggggcgtgaaattgaggctgttttgcgtttcaagcggtaagttttgccataagaattggcaacgttcggcaagatttaaggttgtcaattttgtcgtggaacgcaccgcttgccaatcaaagagatgtaaacaggctagttggtcagctaatttttcgagtaacggttggctaaaatggctgggggtttgcccatcaagccacgctaacaaagcagaggttttgttagcataaataaccttaggggcgaaaccgagtggctcaattagtcgtaaaaaagcgacttcttgttggtaatcaatgccataatcggtggctcgttgcgtttgagaacgtaaaatataacgttcgccattggctaattcgaccaaatgactacaagcggtcagccctgctaattttgtgatagaactgaccgcttgttgttgctgttgttcaagccattgaagtgccattatcgttgaaaacgtaagtaaaaacggtagtttgcactttcaggggttggtttgtctaaagcaaccctttggcgttgtttagcttcaaggaacaaatgttgccaagacgatgtttcttcaccgttcaaggtttgcgtcacgcccgttttgtcgtaccaaaacagcttatagcttaactgcaagggttgttcacttttattgaacaccgcaagttcatctgattttgcgacaacctccgtgatctctgcgacattggcttcgatattaacaatcggcgttgtgcctgatggcagatagctcggcggatttgatccacaagcggtcagaaatacgctcaacagtgcaacaagagaaaaagcgtgtttcatcttatttcgccaacattttacctaacggctcaccgccaacaaggtgcatatggatatggaacacttcttgtcctccgtgtttattacagttcataatcaagcgatagccgtcttccgcaatgccttcttctttagcgattttcgcagcaacggtaaataaacgaccaagtgcttgttcatcttctgcagtaacgtgattaaccgttggaataaatttgtttggaataattaaaatgtgggttttcgcctgtggagcaatatcacggaatgcggtgacaagctcgtcttgatacacgattgccgcagggatttctttacggataattttgctgaaaatggtttcttcgtagttggttagcataatgtttccttatatcagtgttgtaagtggtaggattgtctaacttttttgagcaatttgcaaaaatttctgcaaatttgaccgcttatatttcatttagaggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaattgaactgaatctaaggtaactaagtgagcctgttgataattttctaattcaatggattcgcctgtgttgaggtctttaatcacgagtttattaccttgaatttttacttctaaattttgaactagctctcctgccgaattgataaaagtatagttctcgttttctaaaagtgtgattttggttaatttattgacaatgattttgttgattttcatagtaacctcaggagaaagataagttatgacatttgaattacaaattaacactacataaaaagaaaggtgggtttgtcagtggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtgggtttgtcagtggtttgatatagctcttttaaagaaccatacttttattttttagcgttagagaaagagaaatactctttacaacaaacttcaaaaactactaaaaaaaatttaaaaaattattcctactctaaaaaaataaaagtcaaccgccttgaaaaaattttttagccaaaatttttgtgaaatatgtttgtggtatttgaggaaatgttaagaggtgaacgaaataatcgcgttatttttcgtgatatggtcatttgcatgacaacgggcacattacgagtgcctgaaaataattgcaggaacgccacgcttggcgttcatagaaacattaattttaccgcttgagttcggttgttttgctaataataagaatgttcaccgtgttgatgttcagtcacatctttcacgccaactaattcttctgggaaaagagcaagcaactgtttttcaatgccttcttttaaggtaacgtctaccattgaacagccgttacaaccaccaccaaattgtaataccgcatatttatcttcagtgacttcaattaaggttacacgtccgccgtggcttgccaactgtggattgacttgggtttggatcacatagtctagacgttcaatgaaaggcgcatcatctgccacttttttcattttggcatttggggcttttaaagtgagctgtgaacccattggatcggtaacatagtcaatttcggcatcttcaaggaaaggaaggctgatttcgtcaataaatgcagaaaattgttcaaatttgatttcagtatccgtttcttctacggcattaacagggcagtaagatacaccacattcagcacttggtgtgccaggattaaccacaaaaatgcggatatttgtgccttcttcttgttgatcaagtaatttgcggaagtggttttgtgcaacgtctgagattgtaatgttcatcattttatccatttatgaaaactaaactgtttgctattttatccctatcctgattttttgactagcatcaaatttattaaaaatgaatttaggaagtgtctgtttttcattcattttgtcagggaataaagagtaaaatttgatgtatttcaaagtttcttaggctaaatgttaaaaaaatgtggtaaaactagcaataaaagtgtgttttcaggtagaataccttgtttatttttatcttggaaaaacaaggtaaagcccaatttgagaacttaatgtagcgaacaaatataagtgggggaatcaacgtttatgtttgcttttagctacgctcaatgtagcgattgcagtttctgcaatcattctttttaacccaactaaaagtagtgcaaacaatatgattacaattaaacaaggcttagatcttcctattgcagggaaacctgagcaagtaatccataacggtaataccgttaatgaagttgctgtgcttggcgaagaatatgtgggtatgcgcccttctatgaaggtgcgtgaaggtgatgtggtgaaaaaaggtcaggttctttttgaagataagaagaatgctggcctagttttcaccgctcctgcaagcggtacgattgttgcaatcaatcgcggtgagaaacgtgttcttcaatccgttgtgattaaagttgaaggtgatgaacaggtaactttcgagcgttataacgcttctgagttaagttcattaacagctgaccaagtgaagcaaaatttagttaattcgggtttatggactgcgttccgtactcgtccattcagtaaagttcctgcgttagatgcagtgccatcttctattttcgttaatgcgatggatacaaatccattagcgactgatcctgaagtggtattaaatgaacataaacaagattttgttaatggtttaacggtgttaagccgtttatttgatggacaaaaaataatccacttatgtcgtgcaccagatagtaatatcccaacggctgaagtggctaatgtgaaagtaacttctttcgctggtccacacccagcaggtttaagtggtacgcatattcactttatcgatcctgtttctgcgacgaaaagtgtgtggtatttgaactatcaagatgtgattgctatcggtaaattatttacgacaggggaattatatacagatcgtgtggtttcgttagctggtcctcaagtgaaaaaacctcgcttagtgcgtacacaacttggcgccaacctttctcaattaacagcaaatgaattagctgaaggtgaaaaccgtgtgatttcaggttctgtgttaagtggtgcgaaagcgagcggcgtacacgactatttaggtcgttatgcattacaggtgtctgtgattgctgaaggtcgtgagcaagagttcttaggtatgattgctccatattcacacaaattctctattactcgtactgtgttaggtgcgtttagcaagaaattgtttaactttaccaccgctgttaatggtagtgagcgtgcaatggtgccaatcggctcttatgagcgtgtcatgccgttagatattttaccaacattgttgttgcgcgatttagtatctggcgatacggattctgctcaagcattaggttgcttagagttagatgaagaagatttagcgttatgtacctttgtctgcccaggtaaaaataactacgcaccaatgttgcgtgcagcgttagataagatcgagaaggaaggttaatcaaatggctttaaaagatcttttccataaaatggaaccggctttccagaaaggtggaaagtatgagaaattctatattctgtttgaagcagcttatacgattttctatacaccgggtacagtaactcaaaaagatgctcacgttcgtgatgggattgactctaaacgtatgatgttaatcgtatggttggcattgttcccagcaatgttctacggtatgtataacgtgggtgcgcaatcaatccttgcattaggcgtgggtgactttacccaaaacgtaactcaaaacgtggcaaatgactggcactttgcattagcaaatgcatttggcgtgttatcacaagatgctggcgtatttggcaaaatgttaatcggtgcgattttcttcctaccaatctacttaaccatttttgcagtaggtggtttctgggaagtgctattcgcaatggtgcgtaaacacgaaatcaatgaaggtttctttgttactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatccttttagcattaatcgttccaccaacattaccattatggcaagcagcgttagcaacaacctttggtgttgtggttgcaaaagaagtcttcggtggtgtaggtaaaaactttatgaacccagcgttagcaggtcgtgcgttcttattcttcgcatacccagcacaaatttcgggtgatttagtttggactgcagcagatggcttctcaggtgcaacagcactttctcaatgggcagtcggtggccaagctgcacttaaacacgttgcaacgggtgaaaccattacttggatggacgcattcttaggtaacattcctggttctatcggagaagtatcaactgtcgcattaatgatgggtgctgctattattgtatttgctcgcattgcatcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggtatcttaattggagtaatgtgtgtgttgattcgtgtagcaaacccagcatacccagaaggtatgatgttagcgatcttatttgctaacttgtttgctccaatcttcgactacttcgtggttcaggctaacatcaaacgtaggaaggcacgcaatggctaagtttaataaagatagcattggcggaacacttaccgtcgtgattttattaagtttaatctgttctcttatcgtggcaggttctgcggtgttgttaaaatcggcacaggaagaacaaaaagcccttgataaacagaaaaacattttaagtgttgctggtttattacctgaaggcacgaagaaaagcgaaattaaagatatttatgtgaaaaatatcgaatctaaaatcgttgatcttgcgacaggtgattatgttgaaggtgtagcgaattttgatgcaaaagcagctgcaaaagatccagctcaaagtatcgctatcaatccagcagacgataaagcaggtattagagttcgtgcaaaatatgcggaaatttaccttgtaaaagatgcaaacggacaagtaaatcaaatcgtgcttccattctacggaacaggtttatggtctgtaatgtatggctttgtctctgttgagccagatggcaatacaatcaaaggtatcacttactacgaaaacggtgaaacaccaggacttggtggtgaaattgaaaacaaacgttggcaacaaaatttcgtgggcaaaaaattacaaaatgctcagggtgaatccgcaattcgtattgcaaaaggtgcttcagctgataaagatcacggcattgatggcttatcaggtgcaacactcacctctaacggtgttgatggttcattcaaatactggtttggtgcgaacggctttggtccatatttagcgaaattaaaagcggggactaactaatggcaagcaataaacttaaagatctcttgttatcacctgttgtgaataacaacccgattgcattgcaaattctaggtatctgttctgcacttgcggtaacaacaaaactagaaactgcggtggtaatgggtattgcagtaagctttgtaataggcttttcaagtatgttcattgcgatgattcgtaactatatcccaaatagtattcgtatcattgtacaaatggcgattatcgcatcgcttgtaattctcgtggatcagttattgcgtgcttatgcttacgatctttctaaacagctctcggtatttgttggtttaattattactaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcgtaatgggacgtgcggaagcctttgcaatgaaatctggcccagtagaaagttttgttgatggtatcggtaacggtttaggctacggtgcaatccttgtgattgttgccttcattcgtgagttaatcggttcaggtaaactctttggtatgacggtattccaaactgttcaagatggcggttggtatcaagcaaatggtttattcctacttgcaccaagtgcgttcttcatcatcggcttcttaatttggggcttaagaacttggaaaccagagcaagtggagaaataagatggaacattatttaagtctatttgttaagtccatatttattgaaaatatggcactttctttcttccttggtatgtgtacattccttgcggtatctaagaaagtttcaacagcatttggtttaggtattgcggtaatcgttgtactaggtattgcagttccagctaaccaaattgtttacgagaacatcttaaaagatggtgcattagtggaaggggttgatttaactttccttaactttatcacctttatcggtgttatagctgcactagtgcaaattctcgaaatgattttggacaagtttttccctgcactgtatagtgcattaggtatcttcttaccacttattaccgtaaactgtgcgatcttcggtgctgtatcatttatggttcaacgcgaatataacttcgctgaatctgtggtatatggtatcggtgcaggtacaggctggatgttggcaattgtggcattagcaggtatcacagagaaaatgaaatactctgatgtaccagcaggattaaaaggtttaggtattacctttatttctgcaggcttaatggcacttggctttatgtctttctcaggcattaaattataaggagcgtatcgaatggataattttattttcggtatcgtggtatttactgcccttgtattaatgcttgcagtacttatccttgtagctaaatcaaaattagtggactcaggtgacatcacgatttctatcaatgatgatccagaaaaagcaattaccttgccagctggcggtaaattacttggtgctttagcaagtaaaggtatcttcgtttcatctgcgtgtggcggtggtggctcttgtggtcagtgtatcgttaaagtaaaaagcggtggtggcgagattcttccaactgagctttcacacatcacaaaacgtgaagcaaaagaaggttatcgtctagcgtgtcaagttaatgtgaaaagcagtatggaagtggagcttccagaagagatctttggtgtgaaaaaatgggaatgtactgttatctctaatgataacaaagcaaccttcatcaaagagcttaaacttcaaattccagaaggcgaagaagtaccattccgtgcaggtggctatattcagatcgaagcacctgctcacactgtgagatatgaagattacaaagcgttaatcgacgaagaatatcacgaagactggaacaaatttaacctatggcgttatgtgtctaaagtggacgagccaattatccgtgcgtactcaatggcttcatacccagaagagaaaggcattattatgcttaacgtgcgtattgcaactccgccaccaaataacccagatgtaccgccaggtcaaatgtcttcatatatttggtcactcaaaccaggtgataaagtcacaatttctggcccatttggtgagttcttcgctaaagatactgatgcagaaatggtcttcatcggtggtggtgcaggtatggccccaatgcgttcacacatttttgaccagttaaaacgtctgaagtctaaacgtaaaatgaccttctggtatggtgctcgttctaaacgtgaaatgttctatgtagaagatttcgacagcttacaagcagagaacgacaacttcaaatggtatgtggcgctttctgatccacaaccaggcgataactgggatggttacacaggctttattcacaacgtgctttatgaaaactacttaaaagatcacgaagcaccagaagattgtgaatactatatgtgtggtccaccaattatgaatgcatctgtgatcaagatgttaaaagatcttggtgtagaagatgaaaacatcttattagatgatttcggtggctaatcagctataatcaagcggtcggatttgcaaaaaaatatgcggatctgaccgcttaagatttataggaaaataacaaaagatggaaacattagatatttcggcacttgaaaaagcctttgtttctctgcaaaaaacgattactcacttagataatcaagaatggtttaatgctcaagatccaattatccaagatacacttattgcaggagtaattcaaaaattcgagtttgtttatgaattatcaattaaaatgatgaagcgtcagctgaaaagtattgcttctaatgataccgatatagacagcacagaatttagagatattttacgtctatcagctcaatttggtttaattgataatcctgaagaatggttagatttccgtaaaatgcgaaatattacatcacatacttatgatgaaaataaggctctgcaagtatatcaaggcattagccatttcctagcgagtagccattatcttctctctcaacttcaaaaacgtagccaatgatagatttgaccgaacaacagttacaccttgttcaacgcattttagcgacacatttgccgaatattcccgtatgggtatttggctcaagaattaaaggaacggcaaagcgattttccgatcttgaccttgcattgattaccgatacccccttaacaattcaccaacaagctcagcttgaactggctttttcagactcagatttgccatttaaagtagatttaattgactgggcaagttgtagtgacagtttcaaacaaattattttacagaagtatgaggttttgccttgtctttagcgattattctggtctataaagaaaaatggaaaagctgaaaatagcattaaaagaaatgcggtaacagtcgcatcttcagtacggtaactgcctaattgttggtaaagcaaataaggtaaggtgctaaagtcagggctaccaaaaaaggcaatcacggaaaaattgcctaaacttgccgacattgacagggcaaaagcattgataagcggtcggataagataatttttttccacaatccaccaacggcgaagccctgttaatcccaaactacgagccaatttatcgtgagaaaccaaggcttcccacattgctgaaaacaacaagcgatagatataaggcagtaacatcaaaccgttacaaattcccaccaacaatagtagttgccaagtggttaattgcacattgatcagcagtaaaaatagcccaacggctaacataaatatcggcaaaatcaggggataagtactcacacctgcgagaatgctttgcttgattttctgtttatgataagcaagctggcgagtttcaagagcgagtagataagcaatgcctaccacaaaacaagatgcgataagacttaataacagcgaatagcttgccgattgccacaatgttggcgaaaagagccgttgccaaaagtttgatacagaaatggctgtccaaactacatttgcaagcggtaataaaatggtaaaaattgcccagaaaagcaccgcttgtagtagccatttttccttacctttaggctgtgctgtccagatctcaatcgacacagactgtgttttcactcgctgaaaattaaagcgtgtcacccaatccattatcagttgtaagccaatccctacaaggatttgcaccataattaacatcaccgctttcgcaaaatcaaactcaaaagtcaccgcttggtaaatcgccacttcaagcgtactgtatttaggtcccccccctaacattaatacaattgggaagctggtaaaacagagcaggaaaaccgtcgcataggcatagggcaaaatgccttttaatatcggcaattcaacaatcctaaaatagtgccacccagacagattgagctggttcgccagttggtgctgatgtgttggaataagatgtagcccttcaaggcaatactttgcgacaaggggaatgttcaaaaacagatgagctaacacaatcccttgtaaaccgtacaaggaaaaatcccacgacaatcccaccgcttgaacgagatgggctatccaacctgaatttccccaaaccccgattaatgcaaaaatcaccactaacgaaggcagagcccacgcaaaggaaatcagcttatagagcaaggttttgctccgaaaacgtaggtagaaaaagctacgagccacaaaacccaaggtgctgtattttaaaatttgccacgtttcttgccacgaccaaaaggtttcatcggcactatgttcaaataatgcccagaaactgaacacatagagtgagagcaagccaacatagcttgcccaagcggaaaattgggtgagttttcgggacatttatatctcgttgataatattctgctgtcatataagtaggcaggctattttaacatgaataaaatttttcttaactagaagataatcaatcagttagaaaatataagagagaaagattgcctaacaaagctcatttaatcaccattcaatttttgcaatttgatttttttcaaacaaattgcagaatcctctagtaaaacattcattctttttatacatttcacatacatcttttatttatatctatcttattgttttaataagaaaaattatcatttgcagtgagttatgtgtgaggaggctcgcgtgaaaaaagtcagtaaaatgttaaaaaacagccttgttgcgacaatggctatgttggggtgtttccaagctgcgtgggcaggggaagccaaagagtttgaaggcccaaaacctgatgtgaaaattgaatcagctaaccataaatttgctgaactttatcctttacagtaccaatcttgggctgcaacagccgaatctaaagaagtaacaagtgctttagaagaagatcctcgtttagtggttttgtggacaggttatgcgttctcaaaagattacaataaacctcgtggtcacttctatgcggttactgatgtgcgtaatattttgcgtactggtgcgccaatggacgaaaattctggtcctcagcctatggcgtgctgggcgtgtaaaagtccagatgtgccacgtatgatcgcagaaaaaggcgaagttggttattttgatgcaaaatgggctaaatatggttcagaaattgtcaatcctattggttgtgcggactgccacgataccacttcacaagaatttaaagatggcaaagcggcactgcgtgttgctcgcccacacgttttgcgtgcgttagaagttatcggttggaaattcgatacactggataaacacggaaaacgtgcagcagtatgttctaactgtcacgttgaatactattttgcaggcaaagaaaaagcggtgacgttcccttgggataaaggtgtagatgttgatagcattgaaaaatactttgatgaaatcaaattcactgactgggttcacggcttatcaaaagcaccaatgctaaaagcacaacacccagacttcgaaacttgggcgttaggcacacacggtaaaaatggcgtaacctgtattgactgccatatgccaaaagtggaaaccaaagatggtaaagtgtataccgatcacaaaatcggcaatccatttgataactttgagcatacttgtaaaacctgtcacgaacaaagcaaagagagcttacaagcacgtgtgaaagagcataaaaaacagatcaaagacgtaatgatccgtttagaagatcagcttgttaaagcacactttgaagcgaaaagagcttgggaagcgggtgcaactgaagaagaaatgaaagacgcgttgcaagcaattcgtcacgcacaatggcgttgggactactcagctgcaggccacggcggtcatatgcacgcacctgatgtaattcttcacgttatcggaacaggcttagatcgtgcagctgatgctcgtactaaacttgcagttatcttaacgaaacacggcgtacaaactccgattgagttccctgatatttcaacgaaagtgaaagcacaaaaagttgtaggtatcgactttgataaagagaaagcagcgaaagaagaattcttacgcaccgtagtaccacaatgggaaaaagaagcgaaagagaaaggcttattacctgcggacgcaaaataatttgctaagtcgaggctactatgaaacatattttctcaatgattaagctacaagcggttgcattactgagtttctttgcaatatcttctactgtgttggcagaaatgccagcacaaccacagccaatttggaccaatccgttggataatgtagatggtgcaactattgctaaagactctcgtcgtgatccgaatacttattgtgtgaattgccacggacatttatctgccttcaaacacacaggtaagcactttcaaaaagatacggttagtccaaataacggcaaaccgcttaactgtgtaagttgtcacggcaatatttctgaaaatcaccgtaaaggggtgaaagacgtaatgcgttttaacgcccacggtaaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttttaacgcccacggtaaggctaaaaatccagccttggaacgttcagtcgaagagcaaaatcaagtctgttttgcttgccatagccctgacaaattgcgtgaaaaattctgggcgcacgacactcacgctaataaaattgcgtgtgtaaactgccacaaactacacccagaaaaagaaccaatgaaaggaattgagtctaaacagcgtgtaaaactctgtgtggattgtcacacagaagtacacaaaggtacgtttaaaaaagcggaagctaaggatcaaaaatgagttgttcccgtcgagatttcatctcaggggcgggagcagtgattgccgtggcaggcacaacggggcttgccacaagtcagctctcccttgcgactgagaaagaaagtaaaaccattcgctatgcgatgttgcacgatgagcaagcctgtatcggttgtactgcgtgtatggatgcttgtcgtgaaacaaacaaagtgccagaaggggtatcccgtttagaaattattcgtagccaaccttatggcgaatttccaaacgtaaaatatgaatttttccgtcaatcttgccaacattgtagcaatgctccttgtgtgagtgtttgcccaacaggtgcgtctttcattgataaagcaacaggcattgttgatgttaatccagatctctgtgttggttgtgcttattgcattgcggtctgcccatatcgtgttcgctatattgagccagtgaagaaaactgccgataaatgtaacttctgtcgagatacaaatcttgcacaaggtaaacagcctgcttgtgtagaaagctgtccaaccaaagcactaacatttggtgacttaaacgatccgaatagcgatatttcccgtttaatcaaagaaaaaccaacttatcgcacaaaaatggaattaggcacagaaccaaatctttaccatattaagaaaggggaggcaaaataatgaacgactatgttccattccaaaccccaaatcttgtatgggattcaaccattgcgatctatctctttttacttgggatatctgcgggttcaaccttgttagcagtgctatataagcgtaaagcgaatttagctgatccaagccaaagttggattattcgcacaatggcaataatgtcaccgcttgcaaccatcatcggtttaaccttattgattttccacttggctcgtccgtggacattctggtatctgatgttcaactaccagtttgattcggtaatgtcgatgggggtaatgctattccaagtctttatggcggtattagtcgtttggctggcgatcatctttaagaactggttaagtggctttgggtttattccgaaatttgcttttggattaattgatattgcagcgaaattcacctcgttgattgaaatcctgttgatcttactatcccttgcacttggggcttatacgggtttcttattatctgaattaatcagctatccaatgttaaataaccctgtcttgccagtcttattcttggcttcgggaacttcatctggtattgcagcacttcttgttgtaatcttggtggttggcaaagtcgcaacggatagtcacgaagtacatttcttgcacaagtttgaaaagccagttgcattcattgaaatgttacttttagcaggcttctttgcttacctttatgctaaaggtggacaaagtgcagtggcagcggataacgctttaaccttttcaggctactggggcaaaatgttctgggtaggcgttgtagctatcggtttagttattccaatgttacttaacattgtttcaccagcaaaagtgaaacaccaaaaaggctttatccttttccttgctgttttaggtttaatcggtgttctctgtttacgttactttgttctttatgcagggcaaatgacgattgcttaatctcctcacaagcgggcagatcttgcaaatttatcgcaaaatctgcccgcttgctttttttcaatatcgataaaatgttaatatgcgttcctatccaaaaggagctaatatgaacagaccagtcaaaaatgaaatgtttattgtaattgctaatggtttatggcgtttattagggaatatcgtcaaaacgttaagctatccgtttcacgccttatttccgaaaaagcgttttaccattccagaatttagtccagctaaaagcgtatcagctaaatcaacaaaaattactaaggtcatttggcagactaattacagcaacaaagtaaccttaccagtgtattgtaattatttagttaatcgtatgttgtcacgagattatgactaccgttatgttagcactgaagaacgggcggaatatatcaaagctaatgcagatgaacgtacttttaatgcgtatagtaaacttacggatggggctgcgcaggcagatttctggcgtattttcaccttatataatgaaggtggtatctatatggatattgatgggcatttagtttggaatctcgcttcaattattggtgaaaatgatagtgaagttgttatcactcgccgagacaaatacaccaatttctttttagccagtgaaaagggaaatgcgtttttgaaagaaacgttagagattattgtcgataatattgagcaacgtcgggttgatggtggcgtattttctttaactggaccagtcaccttaaatatggcattggaaggaaaaacggttaatcgtcgccgagataaaatcacttgcgtgcagggaacttttactaacgaatattttcagtatatggataaaaagcgtggtaaatggaatcacgctaaaaatgaagatttattgaagtaatctgatattaagaggcatagtaaacaaaagttactatgccatattggtgtctcaattgattattggggagcctctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggtgtgatagacaaaagaaatatagatatatatctaaagacattatggggaatcaaacaattcctttgcttttaatagtaacagtagggcagttaaatctccaaagtttactacgaatgccgattgttcttgtactttgggtttggcatgtagtgcaacgcctaaactggcatgtttaagcatcagtagatcattggctccatctcctactgtaatccattgctcttgtggaataccaaacttgtgagctagagccattaacgtatctgctttacattgagcatctactactttgccaagtatttgacctgttagtttgccatcaataacttcaagcctatttgacacagaataatctagatcaaaagactgtctgaggtagtctgcaaaatagtcaaatcctcctgaagcaatagctatcttccaaccatattgtttcagacttttaattaataattcaaaaccatccataagtggtaactgttcacgaacttgttgtaagatactttctggtgcattttcaagtgctgcaacacgctgacgtaaactttcttcaaaatcaagttctccacgcatagctcttgctgtaatagatgaaacaatctctccttttcctgctaatttagcaatctcatcaatacactcaattttaatcgcagtagaatccatatccattaaaagtaaaccttcttttttaatgcaaggaagaatatctaacctactaaaatcagcttgtatggtttgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttgtatggtttgagccttctctcgtagagaatctgtcaaatctcctctaaaaaaagcaacatggtaatccaaatactccacttgttttacaaaaatagtagaacttatgtgtgtgaagtgggcaatctgttcagctgtaagctgcttactgtaaataaaaaagatatgtgacatgattctttcaaacctttatagtgagttttactaactttagcaaaattccgtgttagaatcatcttctaattttatggggacaattatgtatatttctcgtgagcaactaataaagagtagcattattgctgtgatcatggcaatttgtttaatgattgtgtggataatactgactggtataaaccatttcaaagtaggttcacagctggctgggattaaccaagtaacaaatctttcccatttacttgtacgacaacaggcaaaattgttttccttgatgttagtaaaaaacgcaaaaaatgatgaattagttgaagcattagatgtttttgctaaagaagcgtttgtcattgatgctaatttgtattcgccatcaggaaatttagttgcacatagtagcaatgcgattgaatttaacccgagagtaaacgacaagatacaacaagagccggcacttacccaacaaattgtagagcctatttttgcacaggatgacttaattgggtttttacgagtaacttttgactctcaatatgggcaaacaacacaacataaagtaaatgaattatttcatttgctttatggtgagttgattattttatttatgtctggagggctatttgttagttgtttctattattttttacagctaaatacaacaaaaacagtttcgtcaaactttatacctattgaattaaaacgtcaaactcaacgttttcactctcgaagaagagcttttcgccgtaaatgattgtaattcaggtaagggagagtataatacctcgcattttgccaatatggcatatttacaatgacacaacttaaatttaatttgaagaggaataaatggctaaagaagattgcattgaaatgcaaggtacaattttagaaaccttacctaatactatgtttcgagtagaactagaaaatgggcatgttgtaacagcccatatttcaggaaaaatgcgtaaaaactatattcggattctaactggagataaagtcaccgttgaaatgaccccatacgatttaagtaaggggcgaattattttccgtgcaagataattgaggtatacataaaaatggaagcgtctagctcccatttttatggtcagctctcggttattttttagtaaagtcaggtcaatcttttgagcaaacgtcgcttaactcagaatcaacaacgtcggattcaaactaaccatcacaaaaagatcaacaaagctgaatttgaatggcaagatgaaatgttgggggaagtccagcaaggtcttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttactcgccacgctaaacacgcagatgtagaaaccgcaagtggtgagattttccgttgtaatttacgccgaacattaaaaaatgtggtggtaggcgatgtagtgtcgtggcgtttgggaagtgagcaattgcaagggattagcggtgtgattgaagctgttcacccacgccaaaatgagctaactcgtcctgactattacgacggtattaaagtaatggcgtcaaatatcgatcaaattatcattgtgtccgctgtgttgccacagctttcactgaatattatcgaccgctatttagtgatttgtgagaatgccagcattcctgccttaattgtgttgaataaaattgatttattgagtgaacaagagcgaaaagaagtgcaacaacagctggcgatctatgaaaagattggctaccagacactctgtttatccgcagacacaggcgagaatatgcaggcgttgaatgcttatttagcgaaaggtacatctattttcgtcgggcagtcaggtgttggaaaatcaagtctaatcaatcaattattgcccgatgtaaatgctcaaacgggggcggtcagcgatatttcaggcttagggcaacataccacaacggcttcacgtttataccacttatctcaaggtggaaatttaatcgactcgccggggattcgcgaatttggcttatggcatttagaagccgagcagattacacaaggttatcgggattttgcttcggtattaggtacttgcaaattccgtgattgtaaacataaagatgacccaggctgtgcattaaaagaagcagtagagcaggggaaaatcgatccgatacgttttgataactatcacaggctcttagaaagtcgccaagaaagtaaaagtcagcggtattttagaaaagaataataaaatcaacgggttgctagataaaaatagcaaccctttctcatttgtaatacttattgattctcatatttatcagcttgttgattatcatctagccgagttattgagaatcatttttatttgttgacaggttaaattttatctataaaatgctgcctgaaaaccccataatttatataaggagactaacgatgaaaaaattagcagcactacttagtatgctttttttggtaagtaatccacttgctgcccagcagtttaaagtggtcaccacattcactgtgattcaagacattgctcaaaatgtcgcaggggataaggctgtggtcgagtcgatcaccaaaccaggtgcggaaatccacgattatcaaccaacgccacaggatattgtaaaagcacaatctgcggatttggtgttgtggaacggtatgaaccttgaaagctggtttgagcgtttctttgctcaagtgaaagataaacctgcggttgtagtaacggaaggtattgaaccgatttcaatctatgaagggccttacaaagataaaccaaacccacacgcttggatgtccacgaaaaatgcgttgatttatattgaaaacattcgccaagccttggtgaaatacgatccggcaaatgcagaagcctataatgcgaatgcaaaggcctatgccgataagatcgttgccttagatcagccgttgcgtgagcgtttggcaaaagtgcctgaagcacaacgttggttagtgacaagcgaaggggcgtttagctatcttgctagagattatggcttcaaagagttatatctttgggcgattaaccaagatgaacaaggcacgccaaaacagatccgcaaagtgatcgaccaagtgcgtaaacatcaaattccagtggtatttagcgaaagtaccatttcagataaaccagctaaacaagtggcgaaagagagtaaagcacgctatggcggtgtgttatatgtggactctctctcaacaaaagatggcaaagtaccaacctatgttgatttactcaatgtgacggtaagtacaattgttgctggatttgaaaaataaaacgatttgggcgaactgctttggttcgccctgcatttacaaaataggattacctaacaaatatgaacattctcctgagttctctttctgtttccgatgtcaccgttcgttatagcaacggacacacggcaattcacgatgttacttttcgccttgacggtggcacaatctgtgcattacttggggtgaacggcagtggcaaatcaaccttatttaaaagcattatgggcttagtccagccaaagggaaatattgagctatgcggactgcctgtcaatcaagccttaaaacgcaatcttgttgcttatgtgccacaaagtgaagaagtggactggcaatttcccgtatccgtttatgatgtggtaatgatggggcgttatggctatatgaattttctgcgtatcccttctgctgtggataagcaaaaagttgctgaagcaatggagcgggtcaatattgctcatcttgcggatcgtcaaatcggtgagctttcagggggacagaaaaaacgagtatttttggctcgttcgcttgcacaagagagcaaaattatcttacttgacgaacctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactggcgtggacgtaaataccgaaaatgcgatcatcgatctactcaaacagcttcgggatagcggtcacttaatccttgtttctacccataatttagccgccgtaccaagtttttgcgatcaagcggtaatgattaatcgcacagtgttagcaacaggatctatcgaaacgacattcacccccgaaaatcttggacgagtatttggcggtgtcttgcgttatcagcagttactcggagaccataaggaataatcaatgcttgagttactgctagaacctttttcctacgattatatgtttaaagcgattgtagtaagcggtgcaatcggggctgtttgtgcttttttgtctgcctatttaatgctcaaaggctggtcgctgattggagatgccttatcgcacgccgtcgtccctggtgttgcattagcttatgccttgtccttaccttatgctgtcggggctttcttttcgggatttcttgccactattgctatcttagcggttaaatccgtcacaaaattgcgagaagatgcggtaattggttttatttttaccaccttttttgccttaggtttattaattatttccatcaatccaacgttcgttaatgtgcaatccatcattctcggcaatatcttaggcattgccgatgaagatatgttacaagtggtgattattttatctgtatcactcttttttctagtgatttactggaaagatttattactcgtcttttttgatgaaattcaagctaaagccgtaggcatttcgccgatgcgacttaaagtactgtttttcagcttactcagtgcctgtattgttgctgcattacaaagtgttggggcaattttagtgatcgcaatggttgtcaccccaggagcaacggcttatttattaacggataaattcggcaaattgttgattatcgcaatttcactgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagtttttccttttatacaacaagctttgctcattggtgttgtggttgccctaatctgtgccgtgttgtcctgctatttagtgctcaaaggttggtcgctaatgggcgatgccatctcacacgccgtattaccagggattgtgattgcctatctgcttgccattccattagcaatcggggcttttgtttcgggcattttctgtgccgttgcagtgggctatctcaaagaaaatagtcgcattaaagaagatacggtaatggggatcgtcttttcgggaatgtttgcgttaggtttggtgatgtttgccaaagtcgaaaccgatcaacatctaatgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcaccgttggctttaatatcaaagtgttacattacagcttactggtgctattggcattagtgattattagtgcaatgcaagtggttggcgtgattttagtggtggcaatgctgattaccccaggtatcacaggctacacgcttgccaaacgctttgaccgaatgttgctaatcgccatcttaactgcagtaaatagtgctttctggggcgtgtttttaagtttccatttcgatgtcgccacaggaccttgtattgtgttgttgcaagcggtgggatttttgggggcgttaggaatcaataaatttaaagtaataggcaaaaaaatttattaaagttatatttttctttaatctatgttaagtccctagatagcaaatcatctagggactttatctttattaattaactaattaaccacttctcaactaattctggtgttgtttctttgtgtcgccacatactgcctaattctggctcagggaatttggtatggttatagccaacaaattcacggaaatcaaatacggcgtgtggataatcatttaacagcaaaaatgcctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaaaaatgcctcgtagccatcttctgaccagcagatctgaaaacggcgaggctcttttagggtttcgggtttgacatcgctgacacgatagacaaataagctatcgaccacaggttgcgcttcttgatgtaaatccattgcatagaaataacctgtttcgccatcatcttcaaacattaccactaaatgttcgtgtttaatggaatgtgtgctgttgcgatagggcgtgccgagcgtaatataatcgtttaggactgaatataacataaggtttcctcttttaattttggcgacattttaacatattctagctgaggaatgcttgggctatctgctgggcgttagaaagtcttttcaaaagcaagagtaatattatgcattttataggaataaagcgtatccaaattgcttttctgtttccgccattccaaattcaatttaggtgtaatgccccataaatgccaatctcgtttccaaacttgtgcgaaaactgaataaatctgatcttggcgagttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgagtggcaagatgccgcccaatatcgcttgatctttaaattggcgatgcgtaaaagagaaatttaatttagttgaaatcccaaaagcgtattcttgcaaccaacctaaacgtaaattctgaatatctgagctgtattgttgctcttgtaagcgttgctgagaaaaggcggcactgacataaaaaaatctgttcggggtttcgataccaaattaacgttgttgatgccgtccgaatatgcctggcttgaggattatctttgaaaaaacggcgtttttcatattcaagtacggtttgattttgccaattttgtgaaagccaaaaactgtaactgatttccgctccattggaccaatgaaacgaatctccaccataccaacgtttttcactttatcaaactgcactcttgctgcgctatcttgtcgatcggcaaagagtacttttgccaattccattcgaattgaatttagttcaggtcgttcgctcaatatttttcggtaaatacgaatagcaacgccatagttctgctgtaaaactgatagtttggcttctgcataagactttaatgtcaaatcttgctgaggctgttgctgatattggtaaagtaaagattggatttgaccgctattattttggtaaatagcttgtttcaattgctcttcaagtgttgttgcggaagcaaaaacaatattagaacaacataaggcgagtaaaaagaaagaacgcataagaatggtaaaagttatattcaaacctagcacgcaaatgcgaactaggtttaactgctcaaagaattagtaacgaataccaccgaatgaagtatcgtagctgttatcgccactgaaagttgcaatacctgctgcttcttttgcaccattgccaaataagccaccttcataagtaccttctcgtaatagagtggttgctttgccgctgaaagtggtaccgtttaattgggttttgtgcaaggtaatatcttgcgcacgtccatcggttaataggctaaattcaactttgtcatctactgtttttttgatcgaaatcatggcacagcttcctgcagaaatgacagataaattaattggacagcgtattcagcaaaagagaaaggaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaaaggaatttggttattcggcagaaaagttgtcggagtgtatcaatttatctcagcaacaactttcacgctatgagcgtggtgcaagcaaaatcaacgttaatcacttgattgatatcgctattttctttaaaacacctattaattggtttttccaagattgtattccagcagaatttactgaaaaggaattaaaagagatagaaataaaccaaaaatgggatagcctgtcttgtgttcaaaaagaagcgtttatcacttttcttgaaacattaaaataattctgcgagagcttaataatattacacctatttagaaaataaacattagcaacaattttgtctactatgctttttaacttaagaaatataaaaggcccttataaattttttccaatattacataatccactgattaccagtggattatgaattgaattacacggtatatttaaaactcttttaatagatttacacttataatttcaagcagccttgatgtttccaaacaattctctcgccctttaataaagaaacgagaagtcatcgctttttcaccattattgaggaaaatctcaaccacagaacggtcaaagaagatctcgacattttccaatttttcaacttcgcaatagcgttgttcaccaaattgcttcattagatctgtttgatctgttgctgaacgatctagggtaactcgcccattttcataacggaaagtcagattttgcccctgctcgttatcaaagaaacggattacaagcggttgattttccacattaaattgcaaatatgcgttgtctaggttttctacttccgtaatcccgttcacactcaacgacactttatcctgcaattgtgcataaatctctttaactggctgttggaaaattttaccctgtttaacggaaagctgacgaggcattgtcagcatagagtgccatttatatttatccgttggatacattaaatctggcaagccaacccagccgtataaaatcccttctgcattctggacagtctgcggtgcatagaaatcaaagccataatctagctcttcaatatgttctgctgtcagcgttgagccagcgaattgacctaacgcataagtggcgtggtaattattttggaaacgtgtcgcttcacgcaatttaccctgtggcgaccagacgaacagatctttatccgccaatttgaacaaatcggggcattcccacataaatacgttgctattatcaaaatcattaatcgcaatttcagagagtaaacgtggggtagcttctaggttatccatttcatagagcaagcctgtgcctgttaggttttcacgttgagcgcctaatacaaaacggattttgccttctgcggtaacaaaaggttttggatcacgaacgtgttccgtatagccttgtggtgcttgatcgataatacaacgcttttcaagcaatttgcccgatttatcaaaaatagcaatattttgatgtggcacacgctgattatcgctcgctcgacgcgtattgcccgtatagaacgcaacaatcttatcttgccataaaatcgccccacccgaataacaaccgtgggattcaaacatctcatcaggaataagcggatcagcttcagtaaatgtttggaaatcctttgtcatcagatgtttccaatgtttcattccgtgcaacgcatcgtaaggaaaccattgataaaaaatatgatatttttcaccgtcaaagattaagccatttggatcgttgagcaatcccgttggcggtgcgagatggtaggttgggcggaaatcctgatcctgttcaaccgcctgacgaactgcatcgagttcaccaacttcttgagcgtgcaggcttttgtatttaccttgattgaaaatgtgcatagtattttcctcctgtgagggtttagttccttgtacaacctgataacatcgtctacattcacccccaaagatgttatttacaacattcttgtggaaataaagacagataaatgaagcaaatgccatatcacacacagaggatttgcgatgcccaagaaatgaaaatctgtcactcagtgacatgtacaactctgtaaatgtaagcgatgtatggagtatacattgataagtgtgcagcttttttacagctaatgcaaccaactttttcacacacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttacagctaatgcaaccaactttttcacacacaaagtgaagaagagaaaaatagatgttgtacaagaattaagaatagatatgctgttttttctatttttgtatagattccacctctggggtattggctcagttctaccaagtggcaattaattcgggcgttgcaccgcttgtgatctttatgggcgttggggcaatgacggattttgggcctttactcgctaacccgaaaacattgctcttgggtgcggcagctcaatttggtatctttgcaacggtattaggagcggtgggtttaaactggttgggtgtgattgacttcactttaccacaagcagctgctatcgggattattggtggggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagatggtgcagttacgaaatgttagcacacgtgagaaagtactgtttccgattgtgttgttgattttggttgcattattgcttcctgacgctgctccgttgttaggtatgttctgttttggtaacttaatgcgagtgagtggcgtagtcgaaagattaagcgatgttgctcaaaatgcgttaatcaatacggtcacgattttccttggcttatctgttggttctaaattaattgccgataaatttctacaaccacaaaccttaggcattttagcattagggattatcgcctttggtattggtaccgcaagcggtgtgattatggcaaaaataatgaaccgttttagcaagaccccgattaatccgttgattggttcagctggcgtatcggcagtgcctatggctgctcgtgtatcaaataaattgggacttgaggcagataaacagaacttcctattaatgcacgcaatgggtccaaacgttgctggggtaataggttcagcgattgccgctggggtgatgttgaaatatattgcggtgttgcagtaaattatttttcgttgttggggtattcatttaataccccaattttttattcatttttacaaaaaatccctcaaattttaccacttgtagtagaatagcgtttttttaaatctattgaggatatttatggattaccctatttgccctgcttgtaaaagcgaaaatacttaccacgattcaattcaatttgtttgccctgattgcggaaacgaatggactggtaatgaagttgaagtcgatgaagatcaattgatcgtaaaggatagcaatggaaacttacttgctgacggtgacgatgttatcttaattaaagacctaaaattgaaaggatcctcagaagtactgaaaaaaggaactaaatataaagggattcgtctagtcgctggtgatcacaatgtagattgtggaaaacttttattgaaatcagaatttttgaaaagagcttagattttaacttagtttataccgtaataggataactatagtaatatggaaagaaaatgtgataacggagacgatattatgaaaaatattgtcgtcatgatttcgggcaatggctcaaatttacaagctattattgatgccattgatactggaaaaatcaacggcagaatttgtgctgttatatctaataaagccaccgcttacggtttagaaagagccaaacaagcggggatttctacctttatttttaccaaaaaagacttttcagataatctggcaatggataatgccattgcagaacaaattgaagccctgcaagccgatttaattgtcttagctggctatatgaaaattcttacccctgaatttaccgctcgttttacaggtaaaattcttaatattcatccatcacttttacctaaatatgcaggtttaaacccacatcaacgagcaatggaggctggtgatagcgaacacggtacgaccattcactttgtcaatgaagaagtggatggcggtgcgattattttacaagcaaaagtgccgatttatcctgatgatgaattagatgatgtgattgagcgtgtttatgaacaagaacatcgctgttatccccttgtggtgcaatggttctgtgacgatagattgaaattagtggaaggcaaagcctatttggataatcaactgttatcgccatagggttatgcgattgacgattaatctgcttgtagaacatatttcagccctttactctcaaagggctttttatcataaaaaaaactaatccgaaacggcaatttatatcgccccaatccattttggaaatatgatctagatcacattttttatgtcagcttctcgttatgatctcttcacaaatatgtaacatataaaaggaaagcaataatgagcaatatgcgtattgaagtcgatctattaggtgaacgtgaagtttctaatgatgtttactggggtatccatactctacgtgccgtagagaattttaatatttctaaaaataccatttctgatgtacctgagtttgtgcgtggtatggtgatggtgaaaaaggcgactgcacttgctaatggcgagttaggggcaattccgaagaaaattgcaaaagcgattgtacaagcctgtgatgagattttggtgaatggtcgttgtatggatcagttcccatctgatgtgtatcaagggggagcgggtacttcggtgaatatgaataccaatgaagtagtggcaaacttagcactggaattattggggcataaaaaaggtgaataccatattatcaacccaatggaccacgttaatgcaagccaatcgaccaatgacgcttacccaacggggttccgtattgccgtttataacagcattatgcaattgattagtaaagtactttacttacaacacggctttgaaaataaagctgatgagtttgccaatatcttaaaaatgggacgcacccagttgcaagacgctgtgccaatgactgttgggcaagagttcaaagcgttttctgtgttgttagatgaagaagtgaaaaacttaaaacgtaccgcagagttgttgcttgaagtaaacttaggagcaacggcaatcggtacaggtttgaatacgccagaaggttacgcaccgcttgcagtgaaataccttgcggaagtcacccagttaccttgcaccttatctgaacacttaatcgaagcgacatctgactgtggtgcttatgtgatggttcacggggcgttaaaacgtacggcggtgaaattgtctaaaatttgtaacgacttgcgtttgctttcatcaggcccgcgtgcaggcttaaatgaaatcaacttgcctgaattgcaagcaggttcttccattatgccagcgaaagtaaaccctgttgtgccagaagtggtgaatcaagtatgcttcaaaattatcggtaacgatacttgtattacctttgctgcggaagcagggcaattgcaattaaatgtgatggagcctgttatcggacaagcgatgtttgagtctatcgacatcttggcaaatgcttgtgtgaacttgcgtgataaatgtattgacggtatcacggtgaacaaagagatttgtgaaggttatgtatttaactctatcggtattgtgacctatctcaatccgtttatcggacaccacgaaggcgatattgttggtaaaatctgtgcaaccacaggcagaagcgtgcgtgaagtggtgttagagcgtggcttgctgacagaagaacagttagacgatattttatcggtcgaaaacttgatgaacccgaaatataaagcaaaacgttttacggaagatgaataattttcgttataatgttacacaatgccaaataattcccttgaaatttaagaataacgccctatttagtagggcgttattttttgtgataaacataaaaggaaaattatgagtacaaaccaagaaacccgtggctttcagtcggaagtcaaacaactgcttcaattaatgatccactcactctattctaataaagagatctttttgcgtgagttaatttccaatgcgtcggacgctgctgataaattgcgtttcaaagctctttctcaacccgaactttatgagggcgacggtgaattgcgtgtgcgtatcagtattgatgaagccttaggcacaatcactatcagcgacaacggtatcggtatgagccgtgagcaagtgatcgatcatctcggcaccattgctaaatcaggcaccaaagagtttttaaatgcactcggttcagaccaagcgaaagacagccaattaatcgggcaattcggggttggcttctactcctcttttatcgttgctgataaagtgaccgttcgcactcgagccgcaggcagtgatgcaagtcaaggcgtattgtgggaatcggcaggcgaaggcgattacaccgttgccgatattgaaaaagcaggacgtggtacggacgtgattttacacttgcgtgatgatgaaaaagagtttttaagcgagtggcgtttgcgtgacattatcggtaaatactctgaccatatcggtttagcggtggaaattcaaaccaaagagtatggcgatgaaggcaaagaaactggcaccaaatgggaaaaaattaacaaagctcaagcactctggacacgctctaaaaatgagatttctgatgaagaatacaaagagttctacaaacatatcagccacgattttgccgatccgttaatttggtcgcacaataaagttgaaggtaaacaagaatataccagcctactttatgtaccaagtaaagccccttgggatctgttccagcgtgaacaaaaacacggcttaaaactctatgtgcaacgtgtgtttattatggacgatgtggaagtctttatgccgaattatcttcgctttatgcgtgggttgttggacaccaacgacttaccactgaatgtcagccgtgaaattttgcaagagaacaaagtcacccaatcactccgcacagctctaactaaacgttccttacaaatgttggaaaaactggcgaaagacaacattgaacaatatcaacaattttggaatgcgttcggtttagtcttgaaagaaggtgtaggggaagatttcgcaaataaaaaccaagtggcagccttagttcgctttgcttcaacgcatactgacagtagcgaacaagcggtcagtttgagcgattatattgcaagaatgaaagaaggtcagaaagcgatttacttcttaactgccgacagctatcaagcagcgaaaaacagcccacacttagagctgttcaacaaaaaaggcattgaagtcttactactttctgaccgcattgatgaatggtttatcagccatttaaccgaatttgacggcaagccattacaaagtattactaaatcagatttagatttaggtgatcttgctgacaaagaggaagaagaaacccaaaaagtacaagaagctgaatttgcgagcttcttagagagagccaaaggctatttaggcgagcgtgtcaaaaaagtggtcttaactcaccgcttgaccgacacagcagccgttgtttcaactgacagcgatgaaatgaccacgcaaatggcaaaactattcgctgcaatgggacaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaatgggacaacaagcccctgaagtgaaatatacctttgagttaaaccctgaacattcaatggtaaaacgtatagctgatattgctgacgaagcagaatttaacgactggattgaactcttgtttgaacaagcgttactcgctgaacgtggcacattggaaaatccaacggcgtttattaaacggatgaataaattgctaggagcataaagttaaaggggcggctgtcgcccctttatttattgaaataaaccgaagcgaatattgtttaaaagtggtgtaatagacaaattggcatagcagacaaaagggggtaatagacaaataaagaaatattgtatacaaaataatacccaaatttatacaactgttgttacaggtttaagtcggtcttatatccttaattattgtataatgccataaacaagttatattcaaactgtgttaaaggtcctctttgggttttactctctaattctcctgttgaataaccattaataaattgtacaaaagcaatacgttctccttttgcattagtcataaatccagctaagttatatactcctttcagtgcgcctgttttagctattacattttttgcaagaggttgcattgacattgaacctctcgcagaaagtgttccatccacacctgcgatgggaaatgtttcaaataaatttaaagttggttcatttctagctattacttctaatgcttgtaaaagcgttcttgcatttactaagttatgtcttgataaacctgatccatcagctatgatgctattgttaaactctatatttgctttagattttaggctatttcttacaaagtagcttgccaaagaaaatgagattgggcggtgatattgtttatttgcgattgttctaaacaaggcatccgcaatttgattatcggattttttcatcattttttttatgagctcttgtagggatgctgaatgatgttccgcaagtaatgtgccttgctgcggtttactttgttgttgaatattaccattaaattgaatcccaatacgttttaaattagctttaataacattccctccatagcttgtagtgtcttgcacggcaaaactcaatccaacaggtttagtttgtttagataagcaacctttaatgtagtagcgattgttatcatgtacaacgacatcaagttcacagaaatttgcttcagatttgtcagcaacataggcactactaaatacttgtactggataggcgctaggaacgctaattttaatcagacttccaatagattgatttgcatctaaattcacataaaaacaattttgatcgatatttactgcagaggagggagcactaaaacagtggctcagatcattccatacccagccgatggctttatcatgactagcaaatacagatgtatctatgatcaaattgccactaatcttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatgccctgttcttttaattgtgaaattagttgaaataactgaccgctagttaaagtaggatctccagtaaatttggcgattaaatctccctctagcacctcattctcaattataccattcgtcaagagcgctgtttgaaatttaaaatctgtgttcagcatgatcttagaggctaaagcagtaaatactttttgagtactagctggcaacataaacaggtcactttgataatcgacaacaatttgatcggtagataaatttttagcgataacactgattgatgtacctttaggtaaatgagagatgaacggtgtaatatcgacctctgctgaagcactataaggcatataaaaaaaaagagttaaaagtaaaattctaagttgtttgagcgaaaatgaaatcatagtaaggttgctatttttataaagaaaatgaataatagtcgactaatactagattatatctctttttctgccaagacattctctaattttggtaagaacttttctattaaggataaaatatgaagcaaattcctatgacagtgcgtggtgcagagcaattacgtgaagaattagattttttaaagaatgttcgccgtccagaaataattagtgcgattactgaggctagggaacatggagatttgaaagaaaatgctgagtatcatgctgcgagagagcagcaaggattctgcgaagggcgaattaaagaaattgaaagcaaattgggaaatgctcagattattgatgtaaagaatatgattaatactggtaaggttatttttggctctacagtgactttactcaatgtaaatacagatgaatgtgtgacttatcgtattgttggtgatgatgaagcaaatattaaggatggcttaatttccgtcaactctcctatagcaagaggattagttgggaaagaaattgacgacaatgtacatatacaaacacctggcggaaatgttgaatttgatattattaaagtagaatatatttaagttaggaaagtggcagttatataaaagtagatgtaaatatagtttttcatgtttcattgtaagagctcaattatcgtactagtggggctatatttacataacttgacgcaaactattgacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaattgtgggagaggctctcacaaatcgacggcagtaattattttttcatctacttcagaccattttttctttaacgacttcccattccatttcattgaaattcaaaaagtatcgccatcaattctagtctgaatttctgttagataaagtgtatttgtgagaggtatagcttgtttaagtagcttgcctcccccaatagtcatgatttcattgctactataaaagcctattcccattgttgccgtgcaagcgaacatcagaaagcccattatttggcaacgctgttcatcactagacttggactataaagagaaaataacagcgcatataatgtatttccttcataataaaaagaaatgcgcctactaacgactacttaaacagtcatagatagacgcataattaaactataataacgacggcgctgcatctaatagaattttggtgtactcttcttttggtgtgtcgaatacatcggcggcattaccttgctcaacaattaatccaccattcattaccacaattctatctgaaacttggcggacggtttgtaaatcgtgagagataaacaccatcgcaagatttaactcttttttcagatcggctaacaggtttagtacctgcgcacgaacggatacgtcaagtgctgaggttggttcgtctgcaacaatcagttttggatttaacgctaacgcacgagcaatcgctacacgttgtttttgtccaccagataaacgagttggctcaacaagtgcggcggaacgtggtaaaccaacacgagaaagtaagtcgtaaacacgtttttcacgttcgtgcggttgcagtacgttgtgaatatccatcgggtctttcaaaatatccaatactcgcatacgagggtttaacgctgttgccgggtcttggaagatcaccgatacttgacggccaaactgtttacgggcttctgcactgccgtatttcatttgtaagccgttgaatttggctgtgcctgatgtcggtttttgtaagccgataatcacgtttgctagggtagattttccgcaaccagattgtcctactaaaccgaccgtttcacctgcattgacttctaagctcacaccgcctacggctgtgaattttttcgggttaaacagcgtgccatcacgagatgggaaccgtacaacaatgttctctaattcaatgataggctgttcttttaatggtttcatactcattgtttatccctccaaatgtgaagcccaaaggtgtttcggattgtcgcttgctggtacaagtttcaagcgttgatttggatttgcatctggacgtaatgaacggcttgcaaagcggtcgcctttcgcaaaatcaaacggtgatggaacactgcccgggatttgatataaacgctctgcacgacattctgttgagagtacagaaccgagcaagcctcgtgtatattcgtgtgttgggttagacaataacgctgaagtcggtgccatttccactacttgtcctgcgtacattacgatgatgtggtgtgccatttgtgcgactaatgcaaggtcgtggctcacgaacaccattgcaaagccaagtttttcacgcaattcgttgagtaatttaattacttcggcttgaacggttacgtcaagggctgtggttggttcatcagcgataagtaattttggttcacgtgctaatgccattgcgatcaatacacgctgacgctgaccacccgataattcgtgtgggtagcggtttaaggttttctctggatcgagttttacccattttaatagggtttcagcagattgtttaccaccacggctgataagctgtgccatttggtctttaatacgcattgatggatttaatgcacttaaggcatcttggtagatcatagagatctcgtgtccacgtaattcgttgagcttatcggtttttaagagatcgtgttggttgcctgcacggtcggtaaagagaatttccccagtgattttggctgtcggtggtaataagcccataattgagaaggcagagatagatttaccacagccagactcgcccactaatcccattgtttcgccttcattaacggtaaagctgatattatcgacaagcggaatatcgccataacgatttgggaaacggattgagaggtttttcacctgtaaaatcggttttgcatttgggtttaattgcatacggtctgtgcgagttgcttctttctcgtgcaatttgagtaagtagcgttttaatgcaagactttctgccattgcttcttgtacatctgttgaaagcggttttgatacgtcttcttttgatgtggttgggctacgtttcaattttggattgactaacgcgtcagttaaaccttctgagagaatgttgagcgagagtactgttaggagaatagccaaaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaaaggttgttgcccaccagaaaccacttaatacgatgttacgtccttctgacaggatatttccccaagatggttgtggaagttgtacacctgcacctaagaaagagagagaagcctcaagtacaatcgcatcagctaccattacggttgcaaagactaatacaggtgcggctgagttgcgaacaacgtgtttgactaagatgtaggtacggctaccaccgataacacgttctgcacggacataatcttcttcccattgagaaaccacgttagcacgcaccacacgagcaagttgtggggtgtaaacaatcgcaatggctaagatgataatcggcactgcgttacctaaggttgcaagcaatactgcggcaagtgcaatacctgggaatgccattaagatgtccataaaacgcataatgacttcgttaccaagtttgtctgcggtagcggctgttgcccctaagatacttcctagaacaatggcaagtcctactgcaccaagtccgataaagagtgatgtttgagcaccgtaaattaagcgagataaaatatcacgtccaagacggtctgtcccaaaccagtaatctgcatttggtgcttgaaccgggcgaagggtttgcaatgggtcgtatggtgatacccacggtgctaaaatagccagtaatgctacaagcacaataaatcctaatgcgagtttagaggcggttgataatgctttaaatcttgccccgcctgaagcaagtctatcagctaatccttggcgaaacattataaactccgaatttttggattaatcagtaagtaaagaatatctacaatgatattcaccaagacgaaagtaaaggcgatggtcaatacgaccccttgtacgaggtgtaagtcgtggtttacgataccgttaaaaatcaatttacccattcccggtaagtcgaagatttgttcgataaccactgcaccacccagtaggtagccgacacgcaagcctaaaacagtaacaggggtaattaaggcattacgcaatacgttatgacgaataaccgttgcataaggtacgccattaccaattgctgtacgcacataatctttgtccatttcttctaccattgtggtacgcaccacacgaattaatgacgcacatacagggattgccaatgctaatgctggtaatgccattgaacggaaatactctgttggatcttcactaaatgacacaaacccacctgatggaagccagtctaattcaagagagaagtattgaattaataagatacctaaccagaatgatggggttgccactgccgctactgagagtaggcggataacttggtctgcccaacggtcacggtagagtgccgcaataatccctaaagagaatgatacgattgctgctaaaaagaccccaatgaaagtaagttgtaatgtaagtgggaaggcttttgcaatcaatgaggtgattggctgttccggcggtgtggttagaccgaagtcaagtaccaaaacgttaccaatgaaacgaaagtattggacgataacaggatcgttcaatccgtgttgttcacgatacaattctttcgcagcatcacttgcactttcacccaatgcaacagaagctggatctccaggtgtgaactgtagaatgataaaaactaatgcacttacgccaagcatcatcagtggtaatgccattaatcggcgtagtaacagacgaagtacgatttctattttttttctccgactacaagaaaggttagtgggataggtttatataatttttataagaaaagcggtgagattaccgaaaaggtttacaacttttacaacaatcttatcgcttgaaagaaaccttaagtaagacgctactttaaacgccttcacccgaaggtgaaggcactatgattatttacggcttacaccaatgaatgacatacctgtggttgataatggtttaaagccatctaatgctttgttactccaagctgttggaagtttacggtgaataattggataaagtgctgcttcttcagcaatgatgttaatcgctttaccccaaatttcacgtgcttctgccggagttttcgcagccaccgcagcgtcaagaagtttttgaacttccgcatattcaggtgtatttgaccagcggaaacgttttttcggccatacatcaccacggtaccaccagcttaataataagtctaagtcgttaccgaatactgatgggtcacctggtgcgattaatacttcaaagttacctgcatcaacaccgtcattgtatggtgattgtgaagcgatgtttgtcacttttacaccagggatcttgttccagtcttcaaggatcatttgaacagagtccactacccatttatgtgcggttgaacgtgttgtaaactcaagtttatctacacccgcttctttcaacaatgcagccgcttttttcggatcgaaatcatagactgttgaggctttcacatagtctgggtgagagtcttgaacataagatgtcgcaggttttgcgttgcctaagaacaccacatcaactaatttttgtgtatcaattgcatattgtaatgcttgacgtactttcttgttgttaaacggtgctttttcacagttaaacattaagaaaattaagccgaatgattgcactgattctacagctgctttacgttttaagcgatccgcatctaagtaaggtacgttttcaatcgcttgtacacgacctgactcttgtgctgcaacacgtgctgcgtcatcagagagtaagaaccatgtcattttttcaacagttgcaggatatggacctgtgtaagcagggtttgcttcaaatacgatacggtcatctttgactgctgaaacaaatttatatggaccagtaccaacagggtttgcatcaaagactgattgaccttgagcttcaattaatgcttttggtacgattttgataatggttaaacgttctttgaataatgcaaatggatatttcaatttaaattcaactgttttttgatccactgcagtgactgatttaatgaatgggatgaattgtgcaaagagtgattttgtatttggatctaatacacgctcaaatgaaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacatcagcactggttactgctgaaccgttatggaataccgcaccgtcacgtaaagtgatgcgataagttacatcgtcaactttttctggttctttcgctgcaagtgctagatatggctggcgagttgctgggtgtaaatcaactaaaccttcaaaaatgtggatattagccgccattgaagatgcaccagttgaactcattgggtcaaaacccgttgaaatcggataagcaatacctgcttcgatagttgaaccttttgctggtgcagcataagcctgagaagcaaaagtaccgattgaacctgagaatgctaaaccagcaccaacacctgcaactaatttcataaagccacggcgagattcattgtgttcaaaatgtttagtcacattagactccttgatagtatcgtttttgtaaaatggttatgtgcagtacaacacacattaaacaaccaaaaagtttcgtatttacttctcattttcaagtgaattaatcaaaatgaaaggtaaaaatgaattgaaaacattataacactaatcaaggcgatgtcaatatactgtcaagacgagtatttacatttgtgatctacttcacgaaatcagaaaataatctagctttagctaggcggataaccgacatcttctaaagtaggattatttgcaccttcttttgctaattgatcacaaatttcattttctgtatgtccagaatgacctttaacccattgccattcaacctgatggcgtgttatggctttatccagagctatccacaaatcctgatttttaactggcgtattattactggttttccagttatttttcttccaattaaaaatccatttttgaataccattttgcatatattggctatcgctatgcaaatgtacattacaaggctccttcaaggcatttagagcggtgatcacggcaagaagttccatacgattatttgtcgtcaagtagtaaccctgacttatccgtttttctttgccttgataacgcaataaaatacctatgccacccttacccggatttcccaagcaagaaccgtcagtgaaaatatcgacaagtttcattggggttatagtacgatagttttattttgataaacaaaaacacgatcagcaagcaccaattctaatgctctgctcaataccgttttttctacatctcgtcctgctcgcatcatcgcatctgccgtataagtatgatccacattaatcacattttgcataataatcgggccttcatctaactcgttattaataaaatgtgccgttgccccaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattttaacaccacgctgataggcttgctgataaggcttcgcaccgataaatgcaggtaaaaatgaatggtgaatgttaatcacacgatttgggtatttcgccacaaactcagggtttaacacacgcatatattttgccaacacaatataatcaggggcatattcatcaattttatccgccaataatttatcgtgttctacacgagttaaaccttcgtggcttactaaatggaaaggcacatcaaaacgttccgctaaacttcttaatgtatcgtgattaccaatcacagctgcaatttcaacattcaaaccaccataataggtcttcattaaaatatcacctaaacagtgtgcttctttagtgactaaaatgacaatacgtttacgttgttgcggaacaagtttataaatagatccttttggcaaggtaaattctaaatcggctaatagggtctgatcgttgaaaataccttgtaattcagtacgcataaaaaagtggcgagtatcactttcaacaaactcactatttttaataatgtttaattgatgtttataacaaatattcgtgattttagcgacaagccccgtatcatcaggacattccgttaataaaattttattttcaatcattttgttttctctatttattagaaaaatagctaattcatatcaatcataaaaaaagaaaacccacatcttgtgggcttctctgtattcatatcaaattagattgcaaaatctgctaatgatttacccgcttctaatgcttgttgaatttcacgaggggttctgccttgacctgtccaagttttttcattaccgtttgcatcaatgaatttatattttgctggacgaggatcacgttttttacgttctactttggttgtgccggctaataataacgcaagttcttctgctgaaataccatcttgagcaagtaactctttgtatttatttaggctttctagacgttttgctttttcttcttgttgaactttaatttcttcacgtttttcttcaataacaagtgcaattttctctgcgataagttccaattgttcaattgaagcttcacgagcaattacacgcaagctacgaatatttgaaagcgtttttaataaatcagtcattgttttctcctaaatgtaactagttcatatcaatttagacttttttttatattatcgtaataattatttcaggtaaatacacaaaataaaattcttattatattttgataataacttaaagcaaactagaataaatctgacatattaatttatcaaaatccatctttcccctattggcaaccgccgtttcttcaggtaagctattggtgtcctacaaattgtagaggtgcgaatgcgataagtattctttcagagtggaaaacgatgaagaaagaggaaaggcgtattcgccgaaatcaattaagcgtcatcttaattggttggtatcgttatcgaaaggaacgatactgtcatagcggaggctatggagtgctactgttaggctgggtttattctgtttttcttttgttcccttccctaaataccttgcttcatcaaaagtaagtttattccagtagatctctttctttgtttgacgtgttattttattaaaaacaatctgagaggttttatgaatctagttgattattcaagttcattatggtctgtagtgcctgcattattagcattggtacttgccattattactcgtcgagtattactctcattaagtatcgggattattgtcggtgcgttaatgcttaccagtggtaacccgattgatacctttttacatttgaagaaaaatatcacttcgttaatttatggcgaagaaggattaaattcaaataacgtaaacatcattcttttcttacttttattaggggtactcaccgccttattaagcatttcaggcagtaaccaagcctttgtaaattgggctcaaaaacgtattcaaggaaaacgtggtgcaaaattaatggcggcggcgttagtgttcgttacctttatcgacgattatttccacagccttactgtaggtgcaattgcacgtccagtaacagacaaattcaaagtttctcgtgccaaattagcttatattcttgactcaacagcagcgccaatgtgtgtgttaatgccaatttcaagctggggtgcttacatcatcactttaattgcaggtctattaaccacttacggcattacaaactacactccattgggtgcatttatggcaatgagtgcgatgaacttctacgctattttctcaatgattttagtctttgtagctgcttatttctcaatcaacttaggctcaatggctcgttttgaacaacaagctgagcaagctgcagatgttggagagcaacaaattgtcgaagcaagtggtagcgtgatgaacttaattttaccaatcatcaccttaattttggcaacccttgcaatgatgatgtacacgggtaaccaagctctagcagaaagtggcaaaccatttgatgtattaggcgcatttgaaaatactaccgtaggtatttcattggttgtaggaagtttgagtgcattagctgtagcgactttaatgattgcaataggacgtaaagtaacaatgagtgattactggaagtcgtacggtatcggtgcaaaatctatgatgggtgcaatcaccattttattctttgcatggacaattaacggcatcgtaagcgacatgcaaacaggtaagtatttatcgacccttgttgctggcaacattaaccctgcatttttacctgcaatcctctttacattaggggcagcaatggcattctcaacaggtacaagttggggaacattcggtattatgcttccaattgctgcggcaatggcagccaacgcagaacccgcattattattgccttgtttatctgcggtaatggcaggtgcagtatgtggtgaccactgttcaccgatttcggacaccaccattttgtcttcaacaggtgcacagtgtaaccatatggatcacgttacttcgcagttaccttatgcggttgtcgttgcggtggcttcagcagtgggttatttagtgattggttttactacctctgcattcctcagctttgcagtaacagcagcggtcttagttactcttgttatcctattcaagcgtaaaaaatagtgatatcagctcttatagtaagatatgagtaaaacaaagcgaatcctcgtaattcgctttgtttatttatagcaaccggttaaaatagctcgattttttacattttatggatagattatgcttcccgaactgggttatttctgtttagtcttattagctggtatttcagggttacaggttttatgttccttatggggagaaattcgccatcaacccttttggttgagtggaaatcgcctatttagtttaattcaagccttattagccttagcctgttttggctgtttagcctacgcttttatctatgatgatttcagcgttgcctatgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctcattctaatagtcaactacccacattcttcaaatttgcagccacttggggaggacacgaagggtcaatgctgttttggctaacggcattggcattatggacaggcatattttgcattttttcaggcaaaatcgaccgcttgtttacttaccgcaccctagcctctctcgccttaattattttaggctttgctttgtttattctcttggtctctaatccatttgagcgtagttttcccccttccccagaggggcgagatcttaatcctatgttgcaagatgtcggattaatttttcacccaccactgctttatttaggctatgtaggctttgctgtcacatttgcaatgacaatggcaatgttgcttggtggcgtgtttgattatgctattgctcgttggatccgcccttggacaatggtagcttggggatttctaaccgcaggcataatattaggtgcttggtgggcttattatgaacttggctgggggggctggtggttttgggaccctgttgaaaatgcctctttaatgccgtggttacttggtactgctctgttacatagtttagtcgttagcgaacagcgaggcatttttagttattggacgattttattagccatctttgcctttgcattaagtctgttaggcacatttattgttcgttctggggttcttacttctgttcacgcatttgcagtggacgcagagcgaggaatggctctgcttattttgttctttagcttgagctttgttgcattggctctattcgctttacgagtgaatttatggcaaggcaatgttcgttttcatctgttttcaaaagaaacggcattattattggttaacggcttatttgcattagccacgctggtggttattcttggtacattttatccgatgatcttcagtgcaatgggctggggctcgatttcggtcggcgcgccctatttcaatacgattttcacccccttagcattgattttgttatgcctaatgggatttgcaatagtgctacgttggaagcatattccacaacgtcaaatcttgtggcaactggcgttactgcccgttgcggtgttgctcagtttgggcttcagttatcaagttttgcaacaggtctatgtacatcaattacagtggcaacccactctttttatctcactcgcgatttgggttgtgctaactcatctaccttatcagcgatttatgtggcaaatccgaccgcttgcaatgcgactggctcatattggttttgcgataagtgtgattggggcaatgatgaatagctattatgctgatgaagttggcgtgagactaaaaccaacgcaatctgctgaattagcggggttacgctttgaatatgtcaaacaccacaatgaaattggggcaaactacaccgctgaagtggcagagtttcacctttatgatcaacatcatcaaaaattggcaaccttattgcctgaacgccgttactatgatgtccgcacaatgacaatggcagaagtggggctagcccattatggtttagatgatatttatattgtgatgggcgataagtttggtaataaagagtacgcatttcgtctgcactacaaaccttatgttcgtattttgtggctaggcggtgcaataatggtcttggcgagcctattggcattggttggttatcggagaaaaaaatgaaaaaaggattgctgtttttaccgcttgttatcttatttgcggtcgtactttttttattaatgcaattaaaagaaaaagacaatataccgttaagcgaagattggcaaggtaagccgttgcctgaatttagcctaaaacatttgctagataatcaagcggttatcagtaaagcaagtttaccaaacgaaccttttattttgaacgtgtgggcgagctggtgtacttggtgtattaaagagtttctgattttacttgagatgaaacaacaaggggtaaaaattgttgggctgacctatgcagatcgccccgaaaatgcacggcaagcccttgctcagtggggaaatccatttgagctagtgattgatgattgggataaaggttttttaacggaaaccctaagaatttcttctgctccctcaagttatcttattgataaaaatggcattgttcgttaccaacaaaaaggctacaaccctaattttgctcaagattttatgcctcgtttacaagcattgaaggaacaggacaaatgaaacggatcctatttttaatgttcagttttatcgccctcgtagctcaggcagaaatggtagacacctttcagttccattctgatagtgagcgtattcgtgcgattaacctagcgaaatcattgcgttgtttacagtgtcaaaaccaaaatctggtagagtccaacgcttctcaagcctacaaattacgtatagaagtctatgaaatggtcaatcaaggaaaaagcgaccaagaaatcattcaaataatgacagatcgcttcggggacttcgtccattatcagcccccctttaatcctcaaacgtgggtgttgtggggaatgcctgttggcttacttgttctactctttagcctgattttttggcgaacacggagaaagcaaaatgattaggaacgaacttaatcgggcttattatcaacaagcggaacgatttgccgatacttttgcagaaaaagagcgtaatgaatatttagccgaattggcaagccgtcaagcgtttgaacaacaaaatgatgtagtatcgcaatggcagaaaaatccacttaaacgcccgcttgtagtaaccgttttgttgattgcccttgtcgccagccttctctattattggcagacagggcgttatagccttgctattcaaggggagcaggcttttgctcaatttcaacaacagcgtgcggaagaaagtagtgaacagcgtaatgatcactatattaccaaccttcaacatcagcttcgccagaatgccaatgatggcaaactctggtttgagctagggcaggcttactcactcaataacgatttcgaggcagctttaacttgttttcgtaatgctcagactgtactgggcgaaaaggcgagtattttaggtgcaatggcaacagccgattactatttgaataaacagcgactttccccgcaagcaaaggcttggcttgagcgagcgttacgaattgatgataaagagagtgccagcttgcttttgcttgcctccgatgcttttttacataacgatttcaaacaggcaattcattactgggaaaaagtattagacaaccagaacgaagccttagatcgtaaagagatcattcaaagtataaaaatggcggagcagatgttacgtgagaaatagtgccatttatggttgtttgatattgatcatcacaataatattttaaaagattctaaatttttaatcttagtttttctttatagcaaacaacaccaactctctcatctggaaacttaccgatacttttgcttccagtggcaaatctgccgtttggtaagcggtaacatttgtgccgtttattgcgatttgataacggtagaattgccctaataacagtttttcaatcactacaccttgcccgttatcatcggcttttagggtaatctgctctgggcgaagcaaccaatgataatcgccaagcggatactcgatttcagggaattgataagtaccaatcgggctttcaaggaagtgattttctaacactttgcacggcaggtagtttgtgccacctaaaaagtcagcaacgaaagcgttcacaggggcgcggtagagttcggttggcgtaccgaattgtacgatcttaccctgatccatcaccgcaattttatctgcaaaggcaaaggcttcttctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgggtaacgaaaatcgcagggactttttggctttttaagatctgtttaatctcttggatcatcgcatagcgagtttggctgtcgatgttggaaaagggttcatcgagcagtaataattcaggttcacaagctaaagcacgggcaatggcgacacgctgttgttgtccgccagagagttcgtgtgggaagcgtccttcaaagccttgtagtttcaccacggataacatttgctgggtgcaacaatgttggtcggatttacacattttgcataagccgaattgaatattttgtgccaccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcaatcggttttttctgtaaatcttccccagcaagaaaaatgttgccttcgctaatcggaagcaaacctgcaatcgctttgagtagcgtcgttttgccacaaccgcttgctcccaatagacagacgatttcattttcgtccacggcaagatcgagggattttagtaccacattgtcgtcaaattgacagctcaaattttgaatatcaagtaatttcatattaacgttctttttgcgattgagagattaacgaacgggtcagccaaataacagggattaatccgactaacaccaacacaatggctggcaaggcggctcgctctaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgtccgaagtaaaggtgaaaacgtgggtcgctaaggtatcaaagttgaacggtcgcaataacagtgacgcatttaactctttcatactttcaataaagaccattaagcctgcggtaataattcctttggtaatcaaggggatatgcacacttctaaacatggataagcccgtttttcccattgtctggcttgccatatccaacgacggtgaaattttgccgagtgaggtttcaaggctaccgattaccattgcagagaagcggatcacataggcaaggactaaggcaaacagtgagccagaaaaaatcaagccaacaggggaaagctctaaagatttcagtagcgcgtgtagttggtgatcggcaaaggttaatggcgacaacaagccgattgccagtacagtccctggaatggcatagcccaatgaggaaaattgtaacgacaagcgggtcgatttcgtccaaaatctgcgattgaccgacagacgatgagcaaaatgcagtaacagagcaagggcaacggtaatgatcgaggcaataatggatacttttaagctatttgaggcaaattgcacaaaatctaaattccacgactgttcaaaatagtggaaagaccaatagattaatcgaccaaatggaataaagaacgccaatgccaacaacccccagcaccagccttgtgcaagccacagtttccagcctgtgagctgtttgaacgaggttttcttttcatagccacgctgatagcttttttgtttgcgacggctgtattgctcaaggctgataaacagaaaaatcatcagcaacataaaaatggaaatacggcttgccgtgccgagatcttgaaagccgagccacgagtcgtagatggcagtcgtcaaagttggcactgcaaaataggacaccgtgccgaaatcgcctaaggtttccattgcgactaacgccataccgacagcaattgcagggcgaattaaagggaaagtaattttacggaaaatatccgctggcgatgaacctaacattctggcactgtgagtgaggttttccgattgttctaataatgccactcgagccagtaagaaaatataagggtagagtacaagggctagcacaaagcaagcaccgtaaagggtgcggattttcgggaaccaataatcgtgcggtgtttgccaaccgaaaataccacgcaacatttcctgaaatgccccagaatagtcgagtaaatcggtataaagataagcgattaaataagcaggcattgctaacggcaagcaaagcaaccattgaagcgttttttgcccacagaattgataattagcgacgatccaagcggacggtaatgcaaaaaaaagtgcaaggacgacagtgcctaagactaacaggcttgagttaagcagataagtgcctagcattgtatcccagagatgaacgagattttccatttcaccttcaaaagcgtgatagccaatggcaagcaacggaagaaggattaacagcgtagttgcaagggcggaaagttgccaagtcaggtatcggtttatcataaatcgatcaaaatctcattccattaaaaaacaaaattccccctttgcgaagaagggggtagaaattaaattcgacgtatttgtaaggacacgacgcttcgtgtcccaatatccacattggttgtgtattagcattggacgccaagcgtggcgtccctacaaacgttacaatattaattatttcgcaccgaaatcatcaaatttaacttcatcaactaatttcaatgctttttcatagtttttcgcaatgtcttctaattttaatgcatcggttgagtaagttccccagccttttacaagatcagaaggtgcaacgtcagcttttactgggtactcgtggttaagtttagcatataaagcttgagcttggttgccactgagatactcaattaatttaattgcatttgctttgttcggtgaatgtttcgctaatgctacaccactgatattaacgtgtgtaccgtattgaccgttagggaagttaatgttcgcagactcagcccaagatctttgtttttcatcatctaacattttaccgtagtagtagctgttacctaacgcataatcacaaatgccttctttgattgctttaacttggtcacggtcgccaccttgtggtttttgtgcaagatttgcttttaagccttctaagaatgctttggttttttcttcaccgtagtgttcgatcattgcagcaaagagagaaacgttgtaagcatttttgccagaacgaacgcacactttgcctttatattcaggcttagctaaatctaaatagtcaaacccagcaggtaatgcacctacacgatcttttgatgtataaataacacgagcacgtttggttaaaccgaaccattcgccatttgaatcacggaactgcgcaggaatatttttctctaaagtttttgagtctactttttgagccaagccagctttcacaatttgcattacacggctaatatctaccgttaaaagcacgtccgcagggcttaattcgccttctttttgtacacgttcaactaaacctttgtctgcaaagatcacgtttactttgatacctgtttgtttttcaaagtcttttaacatcggctcaattaagtacggctgacggtaagagtaaacattgacttcgtttgcagctaacgcagaagttgaaataacagaagataatgcaagtgcaagcacagaaagagattttttcataaaaatgtcctcattaggaaagggataaactcactataaatagcgagcgtttacaaaacagtgtgagtttaaaatatttacatttttatgtcaagtaagaactatttttatttactaatgggtagttaatctcattcttaataagatgaaaagtgaaacctttttggggcatcctatagtcgcagcatattatccggtattatgaatcaagtgcacaaatacctcatttcaataaaatctgtgtataatacctgctgttttgttagcaataattttgctttcaatgaagttaatgtttgctcgtataattttgtactgccttcgtgattaatagagcaacagactgtaaagcctatgttaagcagagtattgtctttttcatttaaattattccgtaaattaagataggttaaaaactaacttaattgtgcaaaaagaaacaaaatgcaatcaagatttaattgataaacattaaatttagcgtctaaaaaatatttagagatgaaagaaaggttttaacgattattcaaatagcatttataaattaaatctattgaattagatcaaaataaccgtagttttttatagggataatatattcgctttttactttatggagtgttaccaatgaaaaaactactgttatcagcgattgccttaggcgttgctggatttttagggatggttgggtatttgcatacctttgaccaagaccaagcagcaaaactacttgcacaaactaattttagtggtaaacagcaagaagtggcgaaagtcttttttgaaaatggctgtcagtattgccacagtcctaatgcagaaatgcctttctatgccaaaattcctggtgtaagttcaatgatggaaaatgatgttgcaacaggcaaccgctttttccgtttggataaaatgttagaaggaatgaaagatcctgctaaattatctgaagcggatctggctaaattagaaacggtgttacgcaacgatacaatgccaattgcgagctttattcatattcactggggttctcgccctgatgagcaagaaaagaaaacggtgcttgactggatccatcaacagcgtgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggatccatcaacagcgtgcggagcattttgttccaaaaaatacggctggagttgatccaactcgcttagttcaacctattcctgatgcattaactacagatccacgcaaagttgccttaggggatcaaatctatcatgacgggcgtttatcaggcgatggcactgtggcttgtagcaactgccaccaattagataaaggcggtgtggacggcttgactacatcaacaggtattcgtgggcaaaaaggcggtatcaatgccccaacggtatataacgcagcctttaaccacttgcaattctgggacggtcgtgcgaaagatttagcggatcaagcaaaaggcccaccgcttaaccctgtcgaaatgggttcacatagttttgatgaaattttagcgaaattcaaacaagatcacgcttttatgcaagagttcttagcggcttatcctgaattaaccgcagacactttaacagatgccattgcagaatttgagaaaacgttgatcacgccaaacagtgctttcgacaaattcttaaaaggtgatcaaaatgccctgaatgacgcacaaaaacgtggttacgaagcatttaaagcggcgaaatgtgacacttgccatacaggtaccgcaatgggtggacaatcctttgaatatatgggcttatatgatgattatttcaaaacgcgtggcacaccaattaccgcagacgatcacggtcgtttctcacaaaccaaagatcctgctgatatgcatcgcttcaaagtaccaaccttgcgtaatgtggctttaaccgccccttatatgcacgacggtagcgttaaggacttaaaagaggctgttcgagtaatggctcactatcaaagtggtaaaaccttaaccgatcaagagttgaacgatattacttcattcctagaagccttaaccggtgaatatcaaggtaaagtattaactcgtcaggattagcataaattgctaagtcgtcacaaaaacgatataggagaaattaatctctgacatatcgtaagaacaagaaactaaaagggctgaaatcaatataatattgttttcagcccttgattaataatttagatttatacaaaccttccttgcttaattttcatcaaacaagaatttttcaaaacattagcgacgtaaacctaaacgtgcgatagtttctgagtatttagcaagatcagtacgttttaagtagtctaataatttacgacgacgtgaaaccatacgtaataagccacgacgaccgtggtgatctttcttgtgctcagcaaagtgtgcttgtaagtggttaatttgtgctgttaaaagagcgatctgaacttctgaagaaccagtatcttttgcatcacgaccaaattcagcaacgatttttgcttttgcttctacgcttagagacattttttactcctaaaaagtagttaagtttatattcatcaatagccgatctctaattcagctacgacacgaagttgcgtattctaaagagaaaagctgtcaagagcaatgcttttctctcagaatagcttaaactaatgtttggtatccgattgactttgtggttgtagatattcttctcgattcggatcaacttgttttgatttacgaatcattggctcaatagttgtaccttgtaccaaaatagagaacatcacaacagaatatgtcatcaccagaattagatctttaacatcaataccattggcataagcagttttggctggaatagaaagtgccattgctaatgccaaacctccacgtaatccgccccagctcatgatttttaaggtatatggattgtaagtacggaactgttgtagcgccttatatggtaaccataagctgatatagcgagatgctagacaaatcggaattgtcagaatcatcatcacaataccgtagatattaaaatcgacgagtaagatcgcaaaaccgataaggaagaaaagcagagaatttaagaaatggtcaatcatttcccagaagtgatcaagataacgttggctctgttcagaaaagcctgaacgacgggtccagttaccaatcataatgcctgccacaatcattgccaacgcacctgaaacgtgcagaacattgtttgcaaacataaagcctgcggttggaatggtcaaagttaataaaatttctaagctaccatcatcggttgatgaaattaaaatatgagcaaggaagcctagcacaaatccaaacaggataccgccgatagcttcatgcaaaaagaggctcataattccactaaaactggcttcttgaccaccaaatgcaacagcaaacacagtgacgaagataactaaaccaacaccgtcattgaaaagcgactcaccttctacttgcatagataaacgcttcggtgctcgtaaatttttgatgatcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtacagcaattgggtcagttggagaaatcagagcaccaaaaacgatacagtaaatcaaatcaatttgtagcccaattaagttggctaccccatagacgaagaaaccaataatcaaagttgaagctaaggttgagaataacgcaaaaatggtaatttcccatttttgatctttaagaacagggagtttaattcctagtgaacctgcaaagagtaggaaccctaaaataccgttaagtaagaaactcttgaagtcgatctgttccatgacttctgttgcgacagcatcaaggttaaaccagccgaaagttccgagtaacagtagtaagagagaaccgatcattgctgcagctgtaatagcaatggtcgattggattttatcgctgattttatgagtaatgaaacctaataaaatagaaagtgctgataaaaaacagatataagtataaatacccatgatggtatccttatggagacaaaaaagaaagatccttgttataaatagtctgcaaattaaaccaaatttttaatctgattgcaaaaaaataaaagatattaagtgagctatttcacaagtaacaatttgagaattttccactttaacggtataattaagagtagttttttgtaattttagggatcataaagatgattgaaaaaatgcatgagaaatctggtgggtgggtatttaaaatcatttttgcattagtttctctttcgtttgtattaggcggtattggtggtgggttgatggctacagacaattccgttgccaaagtcaatggagaagaaatttctcaacaagtatttagccgagcaaaaaatcagcagcaaaatatcctaaatgctcaattaggtgagcgtttttgggatttaatggacaatcctatttatgtcaaacagttccacgagagtattttaaatggtttagttgatgacgagcttcttcgtcaatacgctaagagccttaaaattgacgttagtgccgatcaaattaaatcagaaattgtaaacagtcctgctttccaacaagatggtaaatttaataataatttatatcagcaagcattacgtaataatggtttaacggctgatggttatgctgcaattgtttatgaaggcatgctatttgcacaaattcaagaggctattgtaaatagtagttttaccgttcctgcacaacaagaactattagcgaaattattgttacaaaaacgtcaagtacgtctggcgacctattcaattgcaaaagaggtgaacaatcaaaccgcttctacagaagaaatgcaagcctattatgaggcaaataaagcgaattttgttaatccagaaaaattgaccgtagaatatatttctattgaaccaaaggatttggctaataaaattcaagttactaacgaacaaattgacacttattatcaaacaaacaaagctaaatatacgacaaaaggcgaagcgaaaatcgcacatattcaagtagccactgaagctgaagcaaatgaaatcgtacaagcactcgctaaaggtgaggattttgcacaattagcaaaagcaaaatcacaagataaattatctgctgctcaaggtggagatttaggttgggcgaaagcgggcgtcttcccgaaagcctttgaagatgcggctaatatgttagacgctggaaaaacaagccaaccaatcaaggtagataatgctttccatattataaaagtattagaacgtaatgtagaaactgttgtgccgttagagaaagtaaaagctcaaattacggatacaattcgtaacgagttacttttaacggagtattcaaacatcacccgtgaaatggcaaacgtagcatttgaaaatagtggctcacttgaagcggttgcaaaagtagcgaatgttctagttcataaaacagatgctttcacacgtgaaactgtacctgctgaacttgataacgagaaagtcctacgcgttttattcgacagtgaagtgcgccaaaatgggcaaaattcagaagctattgatttaagtgatgccacaaatactaaaacgatgtttgttcgtgtaagtcactatcaagctgaaaacgtacaaacttttgacgaagcaaaatcagcagttgaacaagcagtgaaacaacaaaaagcgctcaaagtcttagaagagaaagccactacacaagttgcagcattgaataaaggcgaaacagtagaagtcgcatttggtgcctctgaagaacttgtctttgcacaggcacaaatcactgaaccggctttagcacaagcggtcttttcaatggcaaaacctgcagaaaaaccgacatatcagaccgctcgtaatacgaatggtgacgtggttgttatcgctttagataaagtgagcgatggcacagctgacgagtttaaacctttacaagcacagtttaaccaagcagagcgagttgtgttacgtaatgatttacttaaagatttgcgtgaacgtgcaaaaatagaagtaaatcaagacttccttgatcaactcgaaagcagtaaataatatgaatgtgaatttggttaaaaatttgtaattgactttatctataaatttccgcaaaattcacgtaaattttttaatcttcagggcagggtgaaattcccgatcggcagtaaagtctgcgagcggcggcgaaagccaaagcaggaactggtgaaattccagtaccgacagtgatagtctggatggaagaagagctagaatgtctacactcgaacactgttcgagtgcttttcttatgcttttaacgccttgagatcgtgagatttcaaggcgtttgttttttcctctcccgtttacgggagagggaggagccaattcggtagaatttgcggagggagagggtttgcaataaacttccctctctctgcttttcgtaaagccgttactttgctcaaagctgtctctctcccgtgaacgggagagaattattcttcttccttgcccttcaatttatgatttaaaacccaaaatgacacactctatttttatggctcgtgccattgaactggctgaacttggtcgtggctggacaaatcctaatccgttggttggttgtgtgattgtcaaggacggcaacattgttgcggaaggctatcaccaacgctacggcgaatggcacgccgaacgtaaggcgattttacattgtcaggaagatttaagcggagcaacggcttacgttacccttgagccttgctgtcaccacggacggacaccgccctgttctgatttgttgattgaacgggggattaaaaccgtcgttatcggctcaagtgaccccaatcctctcgtggcaggcaaaggtgtggcacaacttcgccaagcggggattgaagtgattgaaaatgtgatgaaagccgaatgtgatgcgttaaatccaattttctttcactatattcaaaccaaacgcccttatgtgttgatgaaatatgcgatgaccgcagacggtaaaattgccaccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaaaattgccaccgcaacaggcgaggccaaatggatcacaggggagcaagccagagccaatgtgcaatgcacccgacatcaatacagtgcgattatggttggagtagataccgtgttggcggataacccgatgctcaatagccgaatgccaaatgccaaacagccagtacggattgtgtgcgatagccggttacgtacgccattagagtgtcaattagtccaaactgccaaaacctatcgcacgataattgcgacagtttcagacgatttgcaaaaaatcgcccaattccaaccgcttggggtggaagtactggtctgtaaagcaaaagacaagcggatcgatttagccgatcttttgcaaaaactcggcgaccaaggcattgacagcttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttagaaggtggttcaagtttaaatttcagtgcgttaaacgctggcattgtaaaccgtgtgcattgttatatcgccccgaaattagtcggtggagttaccgccaaaacgcccatcggtggtgaagggatcggcgtgttggcaaatgcggtgcaattgaaaaatgcaaagatccgccaaatcggcgaagatcttctgattgattatgaagtaggaacacattgatatgttcacaggtattattgaagaagtcggcaaagtcgccaaaatccacaaacaaggggaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaatggcggcaaacggacgtttcggcggacatattgtgtcggggcatattgatggcacaggggaaattgtcagcattacccctgcgaataattcggtctggtatcagattaaaaccacggcaaagctgatgcgttacatcattgaaaaaggctcaattacgattgacggaataagcctgacggtggttgattgtgatgaaaacagcttccgcgcatcgattattccgcataccttaagtgaaacgaatttaggcacgaaaaaagtcggtagtattgtgaatttagagaacgatgtaatcggaaaatatgtggaaaaattgctgtcgccgaaacagagcgagccacagagcaatatcaccgaagagtttttaaagcgagtggggttttaaatcccccttagcccccctttttcaaaggggggaattatcaaaaaggaaagcaaaaaattccagaatttaaagtagggacgccacgcttggcgtctgtaacaagcggtcagatttaaagaaaaggaaagcaaatgtttcaattttcaagcgtagaacaagccttagacgcattacgtcaaggcaaaattattatcgtcagcgatgatgaagacagagaaaacgaaggggattttatctgtgcggcggaatttgccacccctgaaaatatcaactttatggtaacttatggtaaaggtttgatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagctcgacctaccgcagatggtttcttacaacaccgataaccacgaaactgcctttaccgttgctatcgatcacattgataccggcacaggcatttcggcttttgagcgttcgattacggcacttaaagtggtggacgacaacgccaaaccaagtgattttcgccgtccagggcatatgttccccctgcttgcaaaagacggtggcgtgttggtgcgtaacggacacacagaagcaacggtggatctggctcgtttagcagggcttaaacacgcagggctgtgttgtgaaattatggcagacgacggcacaatgatgaaaatgcctgaactacaagcctttgccacaaaacacaatatgccgtttatcacaatcgcccagcttcaagaataccgccgagcaaaagattgtttaattgagcagatttctgtggtcaaaatgcctaccaaatatggcgactttaccgcacatagttttatcgagaaaatcacaggcaaagaacacgttgccttagtgaaaggggatattggcaatggcgaagaggtgctgtgccgtattcactctgaatgtttaaccggcgatgcctttggttcacaacgttgcgactgcggtcagcaatttgccgctgcaatgagccaaattgagcaagagggtagaggcgtgttgctctatttacgtcaagaggggcgaggcattggcttaatcaataaactgcgtgcttatgagttgcaagataaaggaatggacaccgtcgaggcaaatttagctcttggcttcggtgaagatgaacgtgaataccatatcggtgcacagatgtttcgcagtttaggcgtaaaaacaatccgcttgctaaccaataacccagcgaaaatcgaggggttacagcaagttggcttaaatatcgtggcacgagaaccgattatggttgaaccgaataaacacgatttggaataccttaaagttaaacaagttaaaatgagacatctgtttaatttctaaacttgttaaatgacattcattttacggacacacgcagtgtgtccctacgacagttttatttttatatcaatttacattcaatataaggaaaagcaaaaatggcaattatcacaggtaatttagtggcaacagagttaaaattcggcattgtgtgtgcgagatttaacgattttatcaacgacaaactgttaagcggtgcgattgatacactcgttcgccacggtgcaagcgaaagcgatattgataccgcttgggtgccaggagcatttgaaattccgttggttgcgaaaaaaatggcggaaagcggtaagtatgatgcagtaatctgcttaggcacagtaatccgtggctcaaccacgcactatgattatgtgtgtaacgaagccgcaaaaggcattggtgcggtgagcgtacaaaccggtgttcccgttattttcggcgtattaaccactgaaaatatcgaacaagctatcgaacgtgcaggcacaaaagctggcaataaaggctcagaatgtgcgttaggtgcgattgagatagtgaatgtgttgaagggactttgatatttttattcactagagccttccccttttatggtcacattatggcgatcgcataggcgatcgccaaataacacaataaactactttggataatacaatttaccttcgccatataaaaagagtttataacaacaacccatcatcactcaatttctcgtgacgactttgctcaaacaaacgtaataaatctggtacgtccattttcttacgggcgtcgcctgccacatcaaaagccacctgaccttgatgcaacattacagttctatccccataatctagggcttgtcgcattgagtgcgtcaccattaacgtagtgagtttttgctttctaacaattttattcgttaattctaacacgaaagcggtcgttttcgggtcaagtgctgcagtatgttcatcaagcagtaaaatatttgagggttgtaacgatgccattaataaactaaccgcttgtcgctgcccccctgataatctgcccatttggtcagtcagacgattctccaagtctaatccaagtaaggataatttctctttgaacagctctctgacttggcggttcagtgcaaaacctaaccctcgtttttgacctctttgataggctaaagccatattttcttcaatggttaaggcttcgcaagttcctgtcattggatcttggaaaacacgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccgttactgccaatcaccgatacaaattccccttcggcaacattcaggctcaatcctcgtagtacaggattttcaatcacagtgcctttattgaacgtaataaatagattattcaactcaatcattatcgacctctttttgctgtgaatttgtgcttgaatttaggtaacgcaagaaccgctacaactaataatgccgtgattaaattaagatcttgaggcccaaaaccgataccattgagcgtttcattatttaaggctaatgcaatgaaaaagcgataaagaatagaaccaataatcaccgctgcagttagacaaataatacgttttgcagagaaaatcgcttcaccgataatcactgcagcaagcccaatcacgatggtaccgaccccaatcgaaatatcaaagccaccgttactttgtacataaagcgatcctgctaatgcgattagcccgttagagatagccataccaagcaaggtcatcttattaattgcaataccttgtgcttttgccatacgaggatttgtccctgttgcacgcacagctaaaccaatttgtgttgcaaagaaaagatcgaaaatcaacttagcaataatcaccacaaaaattgccattaacaaccgcaccattgctaactgaacatcatcttgagcggtcattacatcataaatcgtcgcttcacctaacaaagaaacattaggcgatcccataattcgcaaattgatcgaataaagtgcaatcatcatcaaaatactggctaacagtttttcgattttaaaaccaatatgcagacttgccgtaatcatacctgcaaccgcaccagcaaacattccgcacaacgtagcaatccaaggatcgatatgatgcaaaatgcaaagcacacaaacaccgccacctaaaggaaaagagccatcagcggttaagtctgggaaatctagaattttgtacgaaatcagcacccctagagcaacgagggcataaatcaagcctaactctaaagctccgatccaagtgacactggtgaaataagtcgttaaaaattgaagtaaggtatccatctttaaatactactttactagtacaacaatgttttgcattgtacgctatttcagataaaaaaacagtaaaaaatagatttttgtaaatttttttcacgcaaacctttgcttttcaatgggttgccgacaagagaaaaaataagcggtagaataagcagtagatttttcaaataatagaggatacaaataaaatgaacgcaatcgaaattttaggctatgttgcaatgattttagtcgcaggttctttcttattaaaagacgtagtaaaacttcgtttagtgaatgcacttggtgctgtatgtttcgtgatttatggtattttgattaattcattccctgtaacaggattaaatatctttgtggtgtgtgtgaatgggtattatatttggaagagtcgctgttccaaataaagagttcatttagaattgctaaataataggcatttgatttcataagtaatcagatgcctatttatgtatagtaaagagtcattcatgtagagctcttctagagttctatattttcaatgttgctgacctaatatcacaaagccaatgcggcgccgttgtgcgatgcaagattttaaacgatgagcttgcaaaattcggcgatatttactgatagttaagcgtttaacacgctgtttcaatttacgttttatcataaatactccttatttactctatttttaattgatttttatgatttcctgtgtgttatttgagtttgatatttcttgctctttcactctctgatgattgatcaagctattgtaataacgtcggatattttctacatattgaaaggcttcaaatccacgagcatatccgtattttagttgagtatagtaatgttttttagcaagtagaggcaaatttttctttacatcaagccaattatctggatttcctccaagttgtttagttaaacgccgcacatcaatcaaatgtcccattcccatattatatgccaccaagctaaaccaaatacgatcttccgatgcaatactttgaggtagctgattcattaataaatgtagatattctgaaccagctttaatactttgttcaggattaatacgatctgttacattcatcctttctgcggtatctttagtgagcatcattatgcctctcacccctgttggtgatgttgccgtaggatcccaatgagactcttgataagcaatggccgcaagcatctgccattctaatattcctcggtatttttcaaataaatgtaaatatttaggcaaaacagtgtcgatagcttttaaatagctttggctatccacgtagtcaaagcgatttaaataattgaaatatttttcctcaattcttgctattaagcctgtttcattcgcattatccataaaacttaatacggcagcttgcagttcactatacccgctattttgtaaataccatacaacaggctcctcatcggttaaatcaaatccaacggcaacatcaggtttaatatgttgtgcagctgagacatcaatagacacggctacagtataaggaattttgccatcggctacttgtattaataattcctcttgagtgaaattgtctgttactttccatttcaatgaggggtactgttcttgcaatgttgttaaaattggaataacagctgaacctgcagggattagtaattcatcttttaaatcaccaatgctgtaagggcgctgacttccttttttatacacaatctgccatgaggcagaataataacttggaccaatttggaatttatctgcattttctaattgatatagcaatcctgcagcggcaatatcaatttcattgagtttcaaaccattaaataattgttcgctattattgtagtttttaacttctaacccgacacctaaatattcagaaaacgctttagcaagctcatattctatccctgcggttccttctgctccctcaaaataagagatggggtgattaatcattcccaccttcagtattttacgttgttggatctgcgtataacgattttcttctgcctgcattgcttgttgccaaggaaataccatatcccatgcccacagcaataatgcaatcccacatgcaattctgatagctaagcctttcaatttctcctctctaaccttcactctcaacagagtgctgtagtttagcaaatctattatgagttcaatatgaatatattcttaataaatcaatttagtttaaccagtattcccagtttgaaaagaggaattaggggttgatatgtcgttgataagctagaagcgtattttgcattaacatagcaacggtcattggtccaacaccacctggtactggagtaatgaattttgccttttgggaagccacttcatattcaacatctcctaccaattttccctcaatacgattaatgcccacatcaatcactatggcattttctttaatccattccccaggaattaaattaggctttccaactgcgactactaataaatcggcttggcgtacatgattttctagattctttgtaaaacgatgagtgacagtgacagtacagcctcctagtaatagttccaatgccattggacgcccaacaatattggatgctccaacgataacggcatgttttccataaagattctcccctgttgtttctaagagcttcattacaccataaggggtacaagctcttaatgttggaatacgttggcataaacgcccaacattatagggatgaaaaccatcgacatctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctggagagatggcttcaatgatttttgttgtatcaacatgctcgggaagagggagctgaactaaaataccatcaattttttcatcattgtttaatttgttgattaaagagagcagttgtgtttccgttgtgtctgcaggtaaatcataagattcagaataaattcctaattccgcacacgttttacgtttactcccaacatatacctgtgaagcgggatctgagccaacgagaatgacggctaaaccaggagcacggtatccttgttgcacgtaagacgcaatgtgttcaaaaatttgagttttaatttgttgtgcaagtttattacccgaaataatttgtgcggacatgactaattttccctatgtaattgacaatatacattcggtattctctcaaaaaaattgctttttagtaagcattaatcttgaagatgtttaaagaacgaacatttaattgcaattacttaaaaacttattgaccttaataataaaatttttataatagcacgcaccttttttcaagacaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctatcgttttcaaactactatcttatcatagtgcaatgcgcccttagctcagctggatagagcaacgcccttctaaggcgtgggtcaaaggttcgaatcctttagggcgtgccattaaattattttaaaatcaatcacttacaaactatgcaactaatcttaatcgtggttcattttgcgaatgttccgtaaatgtaccgtaaatttcgaccttgtttgcgtgttccagtaaatgatctgcatttaaatgagcatactttttaaccatttctaaggtttcccaaccgcctaattcttttaatgtgaaaagtggtgttcctgcttgaacgtgccaactcgcccaagtgtgccttaaatcgtgaaagtggaaatcagttaataagcatttttttgtagccaaattaaatgcttttcggttaatatcctgtaaaggattgccgtttctgcccacaaatacatatttagaatggcggttgcggatagactcaagaagttttatggcttcttggttcaataatagcgatcgtgccttacctgactttgcaacatcattagtcacgattgctactttcctttcaaaatctatcttatcccaagttattgttaaaatctctgtgcgtcttgctcctgtcatcaaggcaaatttgcagatagatttcatccagtctgaacttaatttatctatgagctgttttgcttgttgtttcgtgatccaacgcactcgaattggcggttcttcctttttctgtacatatggcacagaatccagcataccgagcttatgagcgatatttaatactctcaataaagattttacatacttgttttgcgtactatgagataatgggtccttagtattcgcattcttttttgggatatttaagataatttcttgtgctgttaaagagctgagttctcgccctgcgaatttagagagccagtattctgcgtgtcgctttttcgtggctttatcctttaattcttcagcggaacggacataatgtaataaagcatcttcgaagatgtattttctctttgtttcgagcttatcttctgcccacatttcttgcttgagtttgtcgtgatactgctgtgcttcacgttttacaagcgtgcgagtgcttctcttaattctcttgccgtttggggttgtgatatcaacccaccacggaccgtttgcttttcgtctgtagatcgacattttcttttctcctcgaccgacagagataccccacggtcattattcgcttgttttttttactcggtcaagatctgatcgtttaacccgccaaactttagatcctgccattttaaaaaatccccaatctgctaggtgctggcggacggtatttgggtggcaatttaactctttggcgacttggttaattgttaaatgttctatgtgtgtcattctttttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctttccctgcgatgtcatttctaacataacgtggaatacctaaatcttcgtatagtttacggtggaatacttctacttcttttgcaaaggctcttgctcttgctaggtatttggcaatttgttctgcatctaaacctgtaatggtgatgtcttttttactgcggtcaatcggacgatattgattgccgagtgtgtttaagaagttgataacgtgttcaaacattgtttgcggtagttggtcatacttcgctacgttaaaagtgcttttgagccgagagtagatttcttgccagtgtaatcctgttcgatagtgagcctgttgtaccgcttcctgtatagctcgttgttgctcaggggtgattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaaattcgtctgcgttgcggtcgtagatttttacgattgcttttgtaggatcagcgtattctaatgctgtacctaaatcgtttgctgttaagaatgtgtggttgtttttattgataaccgaaagagtagtgttttgaaatgttaatgtagtcattttattgttccttgtgtttgttttaaaactcatcacaagctactgcaataactggtgatgaactggctaaggtttgcagtaaccgttacacaaggaagacggcagatctttcgatctccttaaccagcccatcattgactactttaaaagggttccccaatttggggctacctttgaaaagtttgatttgactagatttcggctataaaaaaatcgccattaggcgactatcattattaccgccacttattctttcaggactgcgattccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcgaacagggctggagatttagcccgaatcagttggctattttattaaaataaaagcctccattgtggaggcttgtttccagacttgcgagttagatcgcaaaataatttcttagattaatttttgggtattatgattgatattacttcataatcaaccatttaacaaatggtattaaaatcaacatgttactcttttaaatctattccagctagtttattttcgctgtgcattaacaacttctcctatcccttttcgtaaatcatcaccaagctgcctaaaatcattctgcatattttttaagtcatcttgtggagaaccgatatcaattgaagcaaataatggggcgatattgaacatagaaccaaaaccaataaagaaattggcaatgcattgatgttttgtcattttcatattgatttcctaaattaaagttattaagccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactagataaaacaaaggggagccttttagctccccacttcacgattaagttagcttgttatcgctttgcttaatcgaccaaacatttttcagcttggttttacaagcccctttcgggttcactgttaatttaacttaactttaaggctttagcaactgcttttttgatatttgcaaaatcttcatcatcgatcacaggtacgacatattcacgtttttttagcttataacgatctaatcttgataatgatactgtataaaccatatcacatttagcccaacattgaatattgcttttatcaggtaacgggttattaggcattgggtagtgatagggctctaatggctccggtttggtagtacttaatggcacaatggtaaccaattcgctatttttcttgtgctttgatataacgacaacaggacgagttttcaccatttcaggggcaataaaacccgaaaaatcgcacattacaacggctttttctttaggttgatattttaatgccattttaaaatccttgtaataaaaaagccgtaaaatacggcttgaaagtgcggttatcttaatcctaattggcggtgggtgtcaatatcaataaattatataaataatacttgtattttgtttttattatttatataatgaacttgttttcggaatggttctgaaaatgagaagcccgactgaaatcgggcatttaaaaaaggagctaggattatgttttggaaaatcgcaatcctagttatcttgttagtggtaagctcaaatgcttactagttaatggataaccctgcgggggatatgtgagagtgtcccccaacggctcctaatataacaacttcagttttaaaaatcaaccaaaggtaataaaaatggcaaacgctcaaacagaacattctcgtaaacttcgtgcggaaacttcacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaaattaaacccctgcccgtgtgttacgactttttcgatttcttcgtagcggcggacgttaaatttctcaaactctaatactttgactaggctttctgctttagccttgagttgttcgagttcttgctgttgtttgaaattctgtgcgacaagttctgaaatgtgttcgtttgctcgaataacggcaagggcttgccgtgagcagagtgttacataatagtttaactgcttacgcagtttgaaaggattgagggttttcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagttagttaagaattctactttgagcaacttcaatcagtagtttgtattcgtgatgggtcttgtcatcgtggacttcttttgattttgataaaaactcgtccaccgtgcctgtaaagcaaccacgagtaacaattaacccaaattttccattaaagaccgtaagcgttccattttctgaacctacattacttgcccaaaaaatcattttgcgttcagagataactgcaaaagatctcacccgagcatcaccgaacacccgagcgatatcgtacacccgagcatcaccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaagggtgttgccattaattcactttcaacgccttcagcgtttcaataaattgcggaatgtacttatcaaaggctttcatcaacacaggatcggggttttcggtgtggataaaaagcgtttgtttttgatattcagggcagtagctgacaaaatcccaactgtcataacccgtaacccataaggcgacttgtacctgtatgatgtactcactgggtaccacgccctcaatgatatatttgatgtgggttttcattttggggcatttgatttctaagccttttcgtaaggttgggataagtccatcggggcttaccatcatatctttgtcggcattgcgatatacaccaccaacctgaacgacatcattgcctgtggcgaactcatacgccattcttgcttgttcttcaagctgattacctcgcaacatatcgctggatttaaagccttctgttaagccctcaatgctttctgcgacaagttcggcaaggtagcttgtccacgcacttgattttttaccgcttggggtgacgatatttgacacccctgttgcagtgggaatacctaatcgtgcggtaagccattcttctgtgccttgctcacagttgagtgtgatcaggttttctatcataacggtatattttcccctaggttttcgctttgtgcatgtgatttatcaacacgctcattcaagattttgattaaatgttcagctttgtctttcggtagttgatcaaggctgtttacaccatagtacgcaatagctttggcgacatcggtttgtgtaatttggataagttgatcgagttgttggcgttgttcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgagttgttggcgttgttcatcagtgatcctaacaacgccatctacatcgattacggtttgttgtggtgaagctggattaataggctcttcagttatctcatcagcagtgattacaccgcccaattcatcaggaaatgctttacgcaatgcacccgcttcagcacatttagcaagctgccctcgagggcgtttcgtccacattgaattaactttatattttcctgttcgttgtttgtctttccatatttctgttattgcacaggcttcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcacaacgttcaccattaacaaaacgataaacagttactttgcaccattcaggagcattcacaccaagatattctatagtatcgccaaatacaggatcatcttgtcctgccatttgcccggtacgaaatgctgtaattcgttgttcataaatacccggcataattacatcacgccattctttttctgctgtttttgcatccgttacgttcattggtacaatatgacaaggtttcttgagaatatccattttacgagccttgcaataatcaatcgcaagtaaaatactttcgtctttcgcaccagggaaaatgctgttttgtaatgtactccatactgcgtggtctatgccacgttcagaaagtgcggtttgaatgttggatggtaagtttgttgtcataatttatccttattttgctttattaagtgaaacacaatccccaaacttcgctttaagctcacgagcaatattaacagcgtgggattgaatggtttgatttaatcgaatggttatcacaaaatcccctaaaggctctgtggtttccgtttttgcaaaatcctgtggattttcgaccgcttgttgctgtgccatttcatctgcaatagcttttgcctccgcttgaactttttccgcctcagcttttgctttagcctcttgttctgccttggctttaatttccgcctctctctgttcttcttcggcaatgcgttgctgaatgattggctctaactcttcttcccctgcaatcaacactaaccagtctttaaacaggtattcgtaatgaataggaattagctttctgcgtgcggaaattcgagctgcctccgctccgacttctgcggtaattgcggtttcttcggcgttcaccgcacttgttaaagttgccagtgtacttctacgcttggttgcttcttcaaggcgttttttgatattttcctttggaatattacgctcaagggcaagcgatacatcgctttcgtgactgcctttgattgttaaaattgacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacacaaattgtgggagaggctccttatctggtcaagcatctacagaatcatttactaacggttcatataacttaagcttctttggaccaaacgctgaagaaattggcggtaaaatgtcattagatggtaataactacggcttagcaggcactcgcggcgaaatccaaaaataatttgatattgtaggtcgggcatttatgcccgacaccccaatcaataaccatttgtcgggcataaatgcccgacctacattttatgaaaccatctcaattcccttttatttttttactcacaagcccgatacttctggcaaatccttttgctgatcctgttagctttgaacggttgtcacaagcggtcggttttgagcaaaaatttgcaaaaaaatcggcggatctgaccgcttcccctaaaacctctttgccattggcgaatccgcaaagccttgaagctcaaataaaccaagcgattatcgaacaacagtggcagcgtttaccgacattgttacaggcttatcagcaacaatctcattacgatataacccttgttcattatgctttaggggcattttattacgggcagcaacgttatcctgaggcaattgaacattatcaagcggttttagcgcaacagccgacattggcttaccctcgttttgatttaggggtaatgctttacgaaaatcagcaataccgccaagccactgaacagctgacaatgacgaaagcaaatttagacccgtcaatgcaacagctgactgaacgttatttggctagaatggaggaagagcagagttggcaaccggatttcagcctacaatatgtgcgtaccgataatgtaaataatgcgtcatcttcgcctgtggtgaatatcaacggacggcaatttgtcaaagatcaagcctccttaccgcaatcagcagaaggttttcgctatggtattggcgtatcaaaagcccataatttaaccggtaatcactactttaacggttcggttcattacagcggtgtttactactgggataatcaggattacagcgaacaatcgctccgttttagcttgggctatcaatatcgcaatgccaaaatgggcttaggcattacgccttttattgagcaaaattggttgggtagcccacgttatagcagactattcggtgcaaccttacacggttatcgctacttaacgccaaaatggatcgcttcctctcgtttaacgcatagtcaaaaacgttatcacgacagtttaactgcaagccgttatgacggttttaaaaacagtggagctttgacattacgttggcaagcggtcagatcttggcaaatttttgcaagtattgaagccaatcgagagcaaactaaagaaaaagcctcttcttcccataaaattgggggaacgcttggtgttatttaccgttggaaacattggggcagcgaactcagcggaggctatgccaaacgcaattttgaagggaaacattacctttacggctataagcgtgtagataatgaatatcgggcgaattggtcgctgtggaatgagcagtgggcatggaaagggttaatgccgaagctgaattttagttatgtgaaaattcaaagcaatatacctgatttctattcaagaaaaaatggagaatggtttttgacggtggaaaaacggttttaggcttgatttcctaccaccacataatccaacggctcatcccaactctccaacggcaaatactccaactgctgacattgatgagccaacccaacgctgattaactgtttagcttgagaaagggtgcggtcgtaaaagccgccacccattcccagccgattgccttgtgtgtcacaggcaaccagtgggacgaagatcatctctaactcattgagtggcaacacatttcgtacatctaatttcggttgcaaaatcccaaagcgatttcgttctaactgtgcttccccttgatattggagaaaaagcagttggttggctgaaaaggggtgtagcacgggcagatagatctttttgccttgtttgataagtctatccattaacacaagcggtgagatttcgccattaaatggcaaataaaaagcaatatgttgagcggaataacgttcaatgagttctaatgattttaggataatatcttgtgccgcaaaggcttgttcatcagcggttaaggctagacgtttggtggagaaatatcgttcataaaaaagacccgaagtgccgtcatcagttgtggtccttgaaccagacggtccaagggagtcgaacattatcgtttttaggcttctcgtaaacgagcctgctcaccaacaatataagagctcaactcaaagtgttttaaatatcggctcagggacgtaactaacaacgcacacctcaggcaaagagaatactaacggaatttgctaatttttcctagtgttcagatcaataaaatcatagaaattcgctttattcgttattttcttgaccaacagaaaccgaatccatcccactagattggaattttgcaagagaactatctagttgctctacgcacgccattaacacatttttgttttcagcatttttgcgttgttcttgttctaattcatagttgagatttaaggcaacgatcgacaacactttttcaagctgaataataccagattgctcttttagcactgcaactcgatcttctaaccgcttggctgaagccaataacgcctcttgttgttctggtgggcaatatagacgtagcacttgtccaaagagcgataattcaatgttatttttcgacattgttgagaaatccttacgaacacaaaaatttttgctattatgccaccctttgaacaaatcacaaataatctaatatggcaatttcacaatcaagcgactttaaacaactcatttctgagttacatatcgactatacccctgctgaatttcacggttttttaagcggattaatcgctggcggtattcaagatgagtcttggaaaacattaacctatcaatttaccaatgatggacacgcattttctcaagctccacttgcaaaattaaccgaattttatcaacaacttagcgatagttttgatgaagctaacacactcttttcattatggttaaatgaagaagatggttttgcaatggcagatggtattgcagaatggactgggcattttttacttgggttaggtttagcacagcccactttgcagcaagaaactgacgaagttggtgaagccattgatgatttagatgaaatcgccaaattaggttatagtgaagaagataaaaatgatgaattgcttgactcaggcgaagaaattattgagtatctgcgagtcgtcacactctttttacatagccatttcgccaaacctaaaatggcggaaaaaccaaaggttcattaatatcaggggcatacgccccttttattatgccgcttggcgatgataatgccttaacgcctgctctttttgacgagcagaactaaaagacgaaatacgttttaaatagccaatgactctggttgcgtgatcgatgtctttagaaccgcaacagctacattgtgaaagggtgcgtttatcaatatggtcacaggtgttacataaggtgattttcacattgatacaaaaatagttacagcccgtttttgccgcaatgtccaatagtgagcggtagctttgctggctcagggcttcttctaaattcagatgtaatgctgaaccgccatcaaggtattcaaccaacgcttttccgtgtaatagaaatttatctaacgcattgatttgttcatcttctaccacatagaaataagagttatagcactctctcggtacaacatagcccgcttccctgtcccatttcgcatttttcacccctaaattttccgcagggacaaattcggtattaaatttcacgccgtaggttttgcaagcggtctgattggcttgataaattgcaaatagtcgctcacgcacaaaatcaatatattctgaattgtaccccaccttaatgccccgaaactctgccgcttcgaccattccgttaataccaattgtcaggaactgcttatctaatgagataaacccagcatcataaacaggtaacattccctcattgagataatcttccattagctttcggtaagcatattgatattgatggatcttaccgacttctgtcactaaatctcgtccatcttgctccaaacggttcatattgagtgtaataacattaattgagccagttgcaacgccaccagcccctaaggagtaagaaaaggagtgatcggcaatttcattgcgtaaacggcaacaagatgcaagcgaatcaggattatccgattgataaataaagaaggaatttccttcggctaaggattttgccattttatcggcaaaatcactgtctttgcatttgccattttcagtcagcattgcagctgtcacgactggaaaggttaaaatcgctttcgtccgttcttgattaaaccactgcataaagaaatcttgcaacgctgatgtggtttgccaattcggtgcggtaagatcaggaaagacaaaattgccgaacatcgcattaaaatagtaatggtcgtaaatggaaatattccaaaagacactttgataaccacgagcggcagcaggttgattaatgctatacaccacttgctgtaaatggttggcaatttcgtgttgatgtgtttgaagataattatcgccataatccttacgagcaaaatagtcaaaataggtcaaaaactcgacagttgccactgcccctgcaaattgagagctaatcgcaaagacaaggttaataaaagaaccacaaaaagaggcaagatgttgtggtgctcgagattccccacccagtttggttaaaccgtctcttaaaaaaggataaagtgttaccgatacacaataaggcttcagactggtttcatcgtgaacatagatttcgtgtgcttcaatttgacgcagatattcgtccgcaagggattgaccaaaaatctctgcaattttaccgcttactttggctcgattgatttgtacaaagaaatccttcatcaattcctgttccattgtcgctaaattcttttgggtaacgttagcattggcgtccattttggaaccgtccgctgcatttttagcgtgaatgtattggtcaataaaatttaatttgccgagtaattgcgaatgttcaagtctaatcattgtttatcctgtctaaaatgtgcattcagcacttcacctgtttgaagatcaataaatcgttggttggtggtaatacaatttagtccgccaagttcaacaatccagcgacctgttttgacatagtccaacacagctaaaatctctggtggcagttgttcaagctctagtcctgtataaagacaggtttttaagccaaactggcgagcaagctgtaaccgttgcaataactgttcaggcagccattctccccccataaataatacgcaactgatcagcccttgatattgcactaatcgctgttgtaagtaagtttctgagagaatctgaccgcttccaagtttccaactttctatgctgtggcaacctttacaacctaaaggacaacctgaaattagaaaagctaaagaggtttcattggggacttcttgccacacaatctgttctgaaataaaacggatctgtttcattatataaccactatatcttgtggttttaaaccattaaaaacacaatatgtagtagtttatgcattttaatgtaaagggaattgataaaaatcaaagtgagtgaaatcactttgataagctcaaaagaaaaggaagaaaatcaaaaggatagaaaatgtaaatttttttgtatgattaatgccccagccaatttctcaacatctgttccccgtattccgtaataaaagactcagggtgaaattgcacgccatagatcgcaagagagctatgtttaactgccattaatacgccttgatcgcaagttgcagtagcaacaagcggtgtattttctaatgatttttgcgaaatcgcccaagagtgatataagccgatattgaattggtgaggtaaattttcaaacaatggattagcttgttgctgaattaatggacgttgctgtccgtgacgaacttgattaagattgtagagttcaccgccaaaaaattcgcataaggtttggtgtccaagacagacccctaagattgacttgtgttggtgataacgttctagcattgcaaatagttgtggatatgctcttggtacatcaggacctggtgaaatcataatatgactaaaacgttccacgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaactcttccaccgacaccacctgcatttcaaccccgattttgcgtaataaatcaacaaggttaaaagtaaaagagtcgtgattatcaataataagcaacattaaacattatcctgtgttatcggtttttcaaccagtaaatgtaaacgagtcgtatcccaatcggtttcaagtaattcaacttgtggcgttgtctgatgtgctttagcggaaagctgttggaaccgctcgactttccctagtaatccctgtttaccgaccagtgctgttacactttggttatattgattgctcgctgtattcaaggtgttacccaatttagcaagacgctctgcaatgacgcaaacctggttataaatatcccctgctttttcactgatctctcgtgcctctgcattacctcgctcaattcgccataaatttgcgactgtgcgtaaaatcggcattaatgttgtgtgagaaactaaaatgacattacgttcatagccataattaaagagctgtggatcgtgcttcattgcttcaatataagcaggttcaatcggtacaaacatcaacacgaaatcaggactttttatcccaatcaactggctataatttttcttagacaatccatcaatgtgagtacgaagtgaacgacagtgttcatcaagtgcttgttgaattgcaaaattatcttcggatcgtaccgcttgatcgtaggcaatcaaggaaactttactgtctaaaatcaaatgcttatcgtcaggcaacttcaccacaaaatcaggagcaaagcgttttccctcttcatctcggtagctctcttgggcaacataatgttccccagccaaaagccctgctgtttgtaacgcactttctaactgaatttctccccagtttcctgcaattttattattgccttttaatgccgtagtgagattttgtgcttcctgtgacattgacagcccaatctcaagcacgcgtttgatctcagcccctaaatccgcattgccttttattgcttcactatgcacctcattgacacgtttttggaaactttcgatctgctctttaaaaggcttgagcagtaaattgagtgctgactgattactctcagaaaaggatttactcttttcttccagaatttgttgagcaagatgttgaaattcaacatttaactgctggcggacttctaggaaattcttctgttgagcttcaaaatttgcctgtttttccgaaagtgtcgtgcgtaattccgttaattcttgctgtgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaaaatttagcctgtaactgaccgctttctgcttgctgatgttgtagctgtaactgagtttgttgtaactgttcttccaaactttccgctttagtctgagccgaaccgatccgcgcttttaattcattaatataacgctctagttggtcttcctgtaattctgcctgttcaagctgttgctgaagtttttgaatcgctaaatctcgttcatttaaacgctcaagggttgattctgcttttgtctgttgctgaacggcaaattgttctacttgatttttttcaagggaaatttgctcatatttttgcgagagcgttgaaaactgctgttgcaattgttcaagatcctgttgtcgttcttgactatctcgttgtgaacgggaatagctaaaaaagagccaaagtgagatcaataagagtaatgctatcgttgcataaagccaaattgggtcgagattcataggaatatatgctgtaaaaataactagtgttattttaacgagttttgctgttaaaaagcaagggggaaaagtagagtcagaatgggacagctgtgctctatataaaaaattgctacaatagcccactattatagccttgcctatatacaagctatcattttttacaaataggattttatatgacccaatatctttcaacttcatttccagctcaccgccctcgccgtttacgcaaacacgattttagtcgccgtctagttgctgaaaatagcttaactacgagtgatttaatttaccctgtatttatcattgaaggggaaaatcaacgtgtaagagtgccttcaatgccaggtgttgaacgtttaactttagatcaattactgattgaagcggaattattagtcaaatatggtgtgcccgctatcgcgcttttccctgtggttggtgatgcaaaaaaatcactgatggcagaagaagcttataatcctgacggtttggcacaacgtgcagtaagagcgttaaaacaagcctttggagaaaaattgggcgtgattacagatgtggcgcttgacccatttacgactcacggacaagacggcattattgatgaagatggttatgtggtaaacgacattacgaccgaaatcctagtgaagcaagcgctttctcacgcacaagcaggcgcagatattgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccaagtgatatgatggacgggcgtattggtgcaatccgccaagcacttgaggctcacggttttatcaatactcaaattatggcgtattctgcgaaatatgcgtcaaactattatggacctttccgtgatgcagtcggctctgcgggtaacttaaaaggtggtaacaagaaaacctatcagcttgatcctgcaaatggaaatgaaggtctgcacgaagtcgctcttgatattcaagaaggggcagatatggtgatggtcaagccaggtatgccttatttggatttagtttatcgtgtaaaagagacgtttggtgtgccaacttttgcctatcaagtatcaggggaatatgcgatgcatatggctgcgattcaaaatggttggttaaaagaaaaagagtgcattatggaatcactgctttgttttaaacgtgcgggggcagatgggattttgacctattttgcgaagcaggtagcagagtggttgtatcaagaaaagtataaatgagctgagttacggagaacatggcgctactattccaataccttccatatggaactttaattttgaagtagaattactggacattgcccctatattgcgtttaactctgtactattatttataattgataaaatgtaaaatttttccaatctgaatattgggtagaataattaaatgaattaataaaaattctggtatgtcaggaaataaaatgcttatgaatttgctacatccaaccgatttaaaacggtgccaactcacccatcttcattccttcactaaaggaatgaccgtatataagcaaggcgaaaccgccaaagagttttattatgtcaataatggacttattgggctttatcacaccttagataacggcaaagagagccttgttcgtctatatcaaaaaggggattatttcggttatcgaacactgtttggcgatgacggctaccattgcaatgccaaagttttggttgaagcggagatcattcggattaaaccaaaagacattgatactttcttcgtagaaaatccgcagatgagcaaatttttgttgcaatcccttgcaaatgaactgcgagaagcggaacaacgcttggcaaaaagtgcctatttacgcacccttgatcgtgttatcgacagcatttattttctcacggaaaacttcccttactataactggacgcaccgtgaaattgccgaatatgcagggtgtgaaacagaaacagcgatccgtattactaaagagttgaaacgcaacggtttattacaagattggcataaacagaagtaggtcactatgtttgaaaacgcccccaaagcccattttcatttgatggcaaaaccgagtagctttcaatgtaacatcaaatgtgaatactgcttttatcttgaaaaagaatataccattgagcaagatgtgcgttttatgaatgaagacaccttgcgaaattatgtgcgtaagggggttgaagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcaagaatttgcaaacggcaaaacgatcaccaatgcttttcaaaccaatggcatcgccctaaatcgccaatgggcagaatttttcaaaacacatcaatttttgattggtatttcgattgatggcttgagcgaagtacataacaaatatcgcatatcagtcaatggtcagccgacctttgaacgggtcaaacgagcggtagatttattgaaagactacggtgtggagtttaatacattgacggtgattaacgatcaaaattggcataaaggcagagaaacctaccttgctttaaaagagttgggttcaacctttatgcaatttatcccgattgtcgaaacaggctgtggcacagcaccttttgcaaaaaaggaagtaaaaccgaccgctttttctgtgccaccgcaaggttatgggcattttttgcttgaagtgtttaaagagtgggtgcaacaggatgtcggcaaaatttatgtgttggaatttgacaatctgcttgggcaatggcttggctacccgtcaagcagttgtgttcatcaagaaacctgtggcgagtcgctgattgtggaagcgaatggtgatgtctattcctgcgaccattttgtctatccagcgtataaggtgggtaatttaaatgaacagcctttgggcgagattgtgcattcccaaccacaacgcaactttggacaacaaaaaagaaccgcactcactcagccctgttgggcttgtgatgtgcgaccgttttgtcacggcggttgcccgaaacatcgaatgattagcctaccaaatgaagcaaataaacataactacctttgccaatcctaccaactctttttccgcaaaactgcttcatttatgcgaaaaatgcgagatattattcgcagtggtggatcagctggggatattgtgaattttattggcgataaagatgctaacaagaatatataacaaatattactcattggataaaaaaagaatacagccatatgaccttcatgctaataaaagagttataaaaaaggtagtcctgaggtcagctgaagaaagaaaaatcttatatttatcaatgagtttctaacctttatctaaaaaagaaggtgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtttattttctctaaatgttagcaacacttttgtctactatgccttttaagttaactgctcacaatcaccctcaagctatccaatcgccaatttgcttggtctagatgtttcagtgatgcttctcgcaactgctctagggcttgaatttcatcagcacgaatgtttttattcactgcttgtagtgatgtcaagcggtgtaattctgtacctaaagtgtgatccgcattctgttttgcttgttcaattaaggattgtgcctgtggcacaactttttcatcactgaatgcgatcagcttctcaatatcaccacgagccatcttcgcaattttatttgccatctgtttattgaccggcttgagctgtttttccaaccctgcaaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacctgcgatgccatatcgttgcctttgttatccagcaagatacgcacaggcgttggcggtaggaaacgggtgagctgtaaatcttttggtgcttgggcttctacgatatagatcgcttcaagcagtaatgtgcctgccggcaagtttttattgacgagtaatgaaacagcacacttaccaatatcggcggacgtaataagatcaataccgttgcggatcatagggtgatcccacgttaagaacaacacatcttctcgcattagggcaagttcacgatcaaaagtcactgtgttgccttcttcagacaaccctgggaaatcaggcacaagcatatgtcctgtcgggctaatcacaatgcttttctcgcctaaatcttcctgctctagaccaatcacatcaaatagatttaaggcaaaattgaccaactgcggattgtcgtcttgttcagcaatagcttgagctaattgttgagcagtttcaccgccgttcgagttgagttctaacagacgatctcgccctttttctaattccactttaagctgttgttggcgtttatgggtttgttccacaaaggcttcaaaggcttcgctacgttctgggttgagtaggtaagcggtgagttccgcatgaaattctctaaataatgtcgcccccatcggacaagtttcttcaaaggcatttaagccacgatgataccattccgccaagatcaactgggtggagtgattgaaacaaggcacatagatttcaatatcgtgtttttgcccaatacggtctaaacgcccgataccctgctcaagtaagtctggattatcaggcaaattaaacagtactaaacggcgtgcaaactggaagtttcgaccttctgaaccgatacttgaactaatcagaacctgcgctccatcttcttgttgagcaaagtaagccgacgctttatctcgttccacaatcgacattttttcgtggaaaatcgcagagcgaatggcttctttttcacgcaacacttgttctagctgaatggcggtgtctgcttgtttacaaattactagaattttttcatcacgatgatttttcaagaacgtaattaaccactcaatgcgtggatcaaactcgtgccacttcacatttgggttcatacgttggaataggcgttcagggtagagcagatcttccatcttatttccccccatcatacccattactttcaaagcatttgcatattgcgtaggcatttccaacacaatttcattgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccttgacgagtattgcggaatagcacacggcttgttccgtgtcggtcaattaactcactaattaactcttggcggacttcccgacgctgttcttcgctagcatccgaattaataatacggaacatcggctcaacatcttcttccgccagcaattcgctgatactttcctgctctttggcacttaacggcttatcgttaagcaaggtagcgaccgcatcggcgactggctgatactgtttttgctcttccacaaaggcttgataatcgtagaaacggtcaggatctagcaaggctaaacgagcaaaatggctctcttgtcctaattgctcaggggtcgccgtgagtaacaagactgctgaaatctgcttggagagctgtgcgacaaactgatatgccatacttggattttgctcgtcccattccaaatggtgagcttcatcaacaatcaacatatcccaatcggtatcaagcacttgttttgcacgctgtggatttgccgataaccaatcgatagaggcaatcactaaggcttccgtttcaaacggattttcactgatgtcgttattatcttcatctttcttagtgaaatcggcacaacgttcctcatcaaacagcgaaaaattcaggctaaaacgacgaagcatttcaaccagccattgatgctgtaaactttccggcacaagcaccaatacacgatctactcgtccggagaaaagctgttgttgcaaaatcatacctgcttcaatggttttacccaaccccacttcatctgcaagtaacacacggggagcaagacgttgcccgacttctttggcaatatgtaattgatggggaattaggcttgcacgaataccacgcattccacgcagttcagattgaaactgggcttgttgatgcttcaaagcacgataacgcagggcgaaacgatcactgcgatcaatttgggcagagaatagacgatcctgcggtttactaaaactcactttatgatcgagttgcatctcaggcagaacgctctcttcttgagtatcgacacgtttacctaaatagagcgcaacctcttgattttcaacgacatcttcaatatctaactgccagccatcaacactggtaacacgatcgcctttttggaattgcacacgggttaaaggggcaacggcaacagcgtacacacgttgttcgtccgatgcaggaaatgaaagggtcacagtgcggttatccactgcggtgacaatgcctaatcctaagttattttccgactcactaatccaacgttgtccgactacaaagctcatacttacctctctgctattctactaaaattttcggggactatctgatcttggtggagcaagcggtcagattttgccattattgtttccataatttgaactgattaatcaaaccattcgttgaactatcgtggctagtaatggtttcgttattttctagctctggcaagatacggttagcaagttgtttacctaactcaacgccccattggtcaaaactataaatattaaaaatcacgccttgaacgaagattttatgttcatacattgcaatcaacgcccctaaggtgaatggggtgattttttggactagaattgagttcgttggtttgttgcctgtaaatactttaaatggcacaatttctgcaacttcttctaaagatttacccgcttgtgagaactcttgttccactacttcttttgacttaccaaaagcaagtgcttcagtttgtgcgaagaagtttgaaagcaatttagggtgatgatcgccaatcggattatgggtttgtgcaggtgcaataaaatcacaagggatcaattttgtaccttggtgaattaattgatagaaggcgtgctgtccatttgtacctggttcaccccaaatgataggccctgtttggtaattgacaacttttccatctcgcccaacatatttaccgttagattccatattgccttgttggaagtaagccgcaaaacggtgcagatattgatcataaggtaaaatcgcctctgattctgcacctaagaagttattgttccaaataccgataagggcgagtgttaatgggatattttgctctgttggagcattaaggaaatgtttatccattgcgtgagcaccatcaagtagttgctcaaagtgttcaaaaccgatagaaagagcaatagataacccaatcgcagaccagagtgagtagcgtccaccaacccaatcccaaaattcaaacatattttctgtatcaataccaaatttagcgacctctttggcattcgttgaaagagctacgaaatgtttcgccacagcagattcgtcttttgcagtatccaataaccattgacgtgctgaaagagcattcgtcattgtttcttgagtagtaaaggtttttgatgccacaaggaaaagggttgtttctggattgattttcgctaaggtctcagcaatatgcgtgccatcgacattagaaacaaagtgcattgttaagtgatttttgtatggacgtaatgcttcagtgaccatatatggacctaagtctgaaccgccaatcccaatgtttaccacatcagtaatcgccttgcctgtgtagcctttccagtcgcctgaaatcacacgctcacagaagcctttcatcttcgctaaaaccgcatttacttctggcatcacatctttgccatctacttcaacaggggtatttgagcgattgcgtaaagcggtatgaagtactgctcgattttctgtacggttaattttttcaccattaaacattgcgtaagtggctgatttaacttggcattcatcggccaatttacgcaatagggaaagggtgtgttggttgatcgcatttttagaaaaatcaacgagaatttgatcttcaaaacgtaatgaatatttatcaaaacgttttggatcttcattgaatagctgtggaatcgtcaaattctcagctttgtgctgttcaagggcattccaagcgaaagtttgggttggattgatgttttgcattgaattatcctctaaaatttaattttgtgattcagttgattgtgttgagcttagttcatctaagcgtttttctaattcattcaatttttcacgggtgcgaagtaaaacttgagattgaacttcaaactcttcacgagtaactacatcaagtttagcgagttgggcttgtaagatttgtttaaatttttcttctaaatcattgcccacattttttaaaccttgtggtaatgcattgtgaagttgctgtgcgagagattctaaattttttggattaagcataatgttccccttgtaaattagggcattaattctaaagaatttcagtaaagataaaaagcaaagaatagagagaatttgaaaaatcagagaattatttgatctagagaaataagaagatggctggggtactaggattcgaacctaggaatgctgggatcaaaacccagtgccttaccgcttggcgataccccaaaagaaaaaaaactaacttgcgttagttcattcgatttgaaataagatggctggagtactaggattcgaacctaggaatgctgggatcaaaacccagtgccttaccgcttggcgatactccagtcgttttatttgcaagcttaaaatggtgcgggacgagggacttgaacccacacacctctcggcgccagaacctaaatctggtgcgtctaccaatttcgccagtcccgcaaatggtggctacaacgagattcgaacttgtgaccccaacattatgagtgttgtgctctaaccagctgagctatgtagccatttgcgtcaccatatcggctttgcggggcgtattatgctgatttcactctacctcgtcaaatacttttttgaaaaaagtaaatttttctgcttgtttgactagagattcggcaaattgtcagaaaaaacaacaataatctctataaaagactgattttataataagttaacgattgccgttttaaaattccatttcttgttttatctgttttaatataggttcaacatctggtaatacatcttcccacaactgaaacgtataagctgcttgtccaactaacattcctaaaccatcttggtattgtgttgccccttgtgaacgggcgtattcaagaaatggggtctgcatatttggagcatattgcatatcataaatgttggcttgtgtaagtaatcgtgctggcaattcgacgcacttgccttgcaatccaagcgatgtcgcattgataattaaatcgaacgactgttcgggaagttcatcgaaacaagcggattgaatttgcccaaactttgcaaacttttcagctaaactggccgctttatctgccgttcgattgtaaatggtgatctgctgttgagcttgtaataagggataaagcgcgcctttggttgctccaccagcccctaaaatcagtatgcgttgatgtgggttaagccagcctaaacgggcaagatcggatactaatccaacaccatcggtattgtccgcatataaacgcccatcatctaaccgcttgagcgtattacaagcttcggcttgtaagcaactttcgctataaatatccgcaagggcaaaggctctctctttaaaaggggctgtgatatttgcacctttagcaccttccgcaaaaaattgtttgagttgctgttcaaactgttgttcatcgcctaatttcgctacgtaagaaatcgctttgcccgtttgttgcccgaaaagtgtatgtattcttggggatttgctttgtgcaatcggatttccccaaactgcgtactggttcattgtctatccttgtcgaaaaatatgttggctaaaaatgtcacggatttcagacggatttgactttccgcctgtggcttgatctaatactgggaacgatttgccaaattgctgtcgtacttcgtcggcagttaggcaaggtgggagtgtcgttaaatttgcactcgtagaagtgagtgcaaagcccgtcgctgtacaaagctcgacaacggctggcacttggcataatcgcacagcaatggtgtcaaactgccctttcagataacgtggaactgtggctttggctggcattatccaagtaattgcctgttcgcctagcgtttcaaaacgttgccattccacctctgtcaaatgtgtatcatcaatgtagggtagaagcagttttttattatgggcaattaaaatcagccctttttcttctggacgattttttaattgaagcagagatcttaccgcttgctcgctttgcggattgcaacctaatccaaaaacggcttcagtaggataggcaatcacttgattttgtttaagtttttcaataagttgattaaaagaatacattattcgctttcactaaatagatgctgacattttctgtttgcacagagaaaataggattttccacgcacttttttgatggtggctaattcacctaaacattgtggacattgttgctttatgggcttggttggcaaggtaaatttacactcaggaaagcctgaacagccataaaatgttttacctgaacgccctgttcgtgccactaatttatgtttctggcattcagggcagtcaaattcttcctcgatttcagcttcttcgtgtaccgtaaaatggcagtctggatactggctacaaccgataaacataccaaaatgcccttgttttaattgcaatggcgattgacattcagggcattgttcatcaagggttttgatgatatgacttgcttggtggataggtttgagataatcgcattgcggatagctactacaccctaaaaaaagcccctgctttccccgttttagttgtaatggggaatggcattgcggacataattctgtctgtttcgtggacttaaaaaggctcatttttaaactatattaactcaaattcaatcacaaaaaagtcgttatcgttcgggtaaatctctttgatcacttgttttagttcggcaagtgtcatattttcctgtttagcatgtgtttcattaagccgttcaaactgaataggggtaacagacagcacacgaatacgggcaaacaagcggtctgtttcatttgtaaaaacactcaactcttgacccgcttgaaaatagctttctgacttatctcgaatggtaatggtctttttaccactgacaatatctgcttcaaaacggctaaaaaaagtaattttattcatcatagtcaccataatccagatccaataaatgcctaaaatgatcgttataaaaaccgtggctaaccatatatcgccacattttttgcttcgcttttatatcccaatgtgatggtctttttttctcaaaaagacgttcggcaagttcaaaaaaatcaacttccgcttcatcaatggcttggctaatcacccactcttttacccctttgagctgtaactcttgttttagacggcgtggtccatagccttgttgtgaacgatagcggacgtaacttatcgcaaagcgttcatcactttgccatttattcgcttttgcttgttcaatggcttgctcaatttcttgtgcattatattctttaagttgtaatttgtggcgaatttcagcttcgctatattctcgtttagaaagtagataaagcaaatagctattcgcagaatatttatgtgtcatttatttaccgcagtaaaataaaaatgcggttttcacaaaccgcatttcgctattatagttcttcttcgttaaactcttcgacatcgctctcgtcgatactgtcgcttgccgttacttttaataggctatttgggtttgaagccagtgtatttcggatttcttgttcgagtttatctgcaatttcagggttctcttttaaccatttcactgcattatttttaccttgtccaattttcgttccgtcgtaagagaaccaagcacctgatttcttaataaagccatttgcttcagctaaaatcagtagctcattcatacgagaaatcccttcgccgtacataatatcaaattgtacttcacggaatggcggtgcaactttgttttttactacttttacttttgtttcactaccaataatttcatcgccatctttgactacaccacaacgacgaatatctaaacgaacagaggcatagaatttcagtgcattaccgcctgtggtggtttctggattaccaaacattacaccaattttcatacggatttggttgataaatacaactaaacagttggtatttttgatgttcgcagtaagtttacgcaacgcttgtgacattaaacgtgcttgtaagcccatatgcgagtcacccatatccccttcaatttcagcttttggcgtgagtgcagcgacagagtccacaataatgacatcaactgcccctgaacgcactaacgcatcacagatttcaagagcttgttcgccgttatctggctgagaaattagtaattcatcggtatttacccctaaattgcgagcatagacaggatctaaagcgtgttcagcgtcaataaaagcacaggttttattgcctttttgagcttgagcaattaaagaaagtgttaatgttgtcttacctgacgattctggcccatagatttcaacaatacgccccattggcaagccaccaatacctaaagcaaggtctagccctagtgagcctgttgaaacagactcaatatctaattgctcagtctgccctaatttcataatagagcctttaccaaattgtttttcaatttgagctagtgccgcatctaaggcttgttgtttctgttctggtggaacttgtttaatgacggtattgttttttgaagattttttattctcagccataatgctttcctttgttcattgtttggatagggcaaatgcattgccataaaactgtaaattattatactgtttaaccatacagttgcaactatttttttcagtttttcgatctatatcacaaaatttacaactttatcgaaaaatcctatcgcttgtaatcggcactgccctttgaagatcaaaaggatttaaggcattaatcaccattatttgttcataatcaaaaagtgcttctacaggtatatcaattaagctaattttttgttcgtctaataaataacttagttgtgtaccttttaataaataatgatttgggctataccattttccttgttttaaaaaaagtaaattaccaatagagcaatcactaataaagccattattaacaagaataatttcatcaccagcggtttgttttaatttatctaattcaactcggtcagtatatttgaattgataatcaaaattttctacataaacgcattgaaagttttttattgctttaggtatataatggaaaaactgaacttgatattcttttgtgttataatcaatacgacaacgtactaatcctttttgatatgcttcaggcactttaataatatctaacagttcaaaactattttcgtgcttaaaataatatataaatgcattattcattcgttgttgatgataaaaaatattttgtatcttaccatcaataattgctaccgtttcaaagagtggatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagagtggatattggcacataaactttctctaaaatttcattatattctccatctagctgacttaatgcagtaattccgccaccgctacgaaaataatatgtatccccttgtttttcaatatagcgaatagccaccgcactctctacattttcaccatcaaaataaccgaaaatccccgtataataaccacgttcttgttgttctgcttgttgaataatttcaacggttttcactttaggcgcaccgctaattgagcctgctggcaagagtttatccaacattgtgccaatattttcttgccaattttcatcaagttccccacaaatttcagaactcgtctgataaatcgccccacgatgtgtttccactttttcaacatagcgatatttcgtgacctgaatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataggataagaatagattttattcgctttaatacgaatgaaacactcaggggaaaaacagacaaatctttcatctaataacaatttgtatttagctttactttgctgaaaaatttgtgctaaatgataatttgttttaatttcagtttgctgagttaagtttaaaagataactattcccaatttggatctgttgttgaacaaaatcaaaggcttttttatattgtggataatcaggtggaataatctctaactcaaaatttccatttatttttaatggttgaatgaacttttgttgtccattaaaatcaaaataaagccttttatcttcaatttcagataaaggataaattaatggtttctgtttttcaaaatcaattaaaaagaaaaaaggcaaacgcatttttccatactgattggctagttgaataaattgttgcattttaatatttctattattcggagttaaaacctatgtcccattcacattcttatatggagacgcacgcccaacaaaataagactatcctattgattagtttagctattataacgacttttatggttgttgaagcaatctctggctatttctttaatagccttgccttacttgctgatgccgggcatatggcaagcgatagtttatcgctcttattgtcactttttgcataaccttgcaaaacgttttcacgaaatggatattcacgctacattgcaaaatgatttagccgtttattttgaacagcacggaaaaacagagagcacccaccatcattaactatttgatattaatcaaatagttaataaagaccgactaaaatagtcggttttttgttgcctttagttaaaaaaagcataacatctccaacgtagtgcaactttggagaaaaatatggacaacttaatttgctataaacagatgccagtttgggataaggaaagcctaccacagatgtttcaagagaaacataatactaaagtaggaacttgggcgaaattaacaatcttaaagggatcattgaaatactatgaattaactgaggaaggtgaaatcgtcagagaaatgattttcgacgaacaaaaccagccaccttttgtggagccacaaatttggcataaagttgagccactaagcgaagatctagcttgccaactcgctttttattgtacacccgaagattatttcgctaaaaaatataatctcactgcaacacattctgaagtattaaatgcgatgaattatctttcgacaggcaaagtgttagaccttggctgtggaagaggacgaaatgcactttatcttaacttaaaagggtttgatgtaaccgcagttgatcagaatgaagaaagtatccatttcctcaattcaatcatcgaaaaagaagatgcacaacatatccaaacgggtatttacgacatcaaccaagctaatatacaaggtgaatttgactttattgtttccactgtcgtaatgatgttcctaaatcgtcattgtatccctgcaattatcgaaaatatgcaaaaaaataccaaagtcgggggatataatcttattgtctgtgcaatgaacacgcaggatttcccttgtccaatgcctttttcatttacattccaagaagatgaactgaaacagtattatcaaggctgggaacttgttaaatacaatgaagatttggggcatttacataaaaccgatgaacacggcaattgtattcagctacgttttgtgacaatgttggcgaagaagttggggtagatcgcctagttctaatcttcaactcaattttatggcataatgggatctttataagaatctattgttatcaatgacaatagatttagaccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaataatctgaatctattgttatcaataacaatagattcttcgttttatacattatttggattttatcaatgcaagaaccttactatcgcgggcgtttttccgttgcaccaatgctcgattggacaactcgccactgtcgctattttcaccgtcaatttactcaacatagcttactttatagtgagatgattatcgcacccgcaattttgcacgcgaaatatgatctgcttgcttacgatcccacagaaaaccctgtggcgttgcaattagggggaagtgatcctgaacagttagcgaaatgtgcaaaattagtggaagaacggggctatgcggaaatcaatctgaatgtcggttgcccatcagatcgtgttcaaaatggtatgtttggtgcctgtttaatgggaaaagcggatttagtcgctcgctgtgtagaagcaatgaaaaaagaagtgagtattcctgttaccgttaaacatcgtattggcattgacgatctagatagctatgaatttttatgcgattttattgagaaaattcagccttattgtaacgattttattgtccacgcacgtaaagcgtggctgtcaggtttaagtccgaaagaaaatcgcgaaattccaccgcttgattatgaacgagtttatcaactcaagcgggattttccacatcttaaaattagcattaacggcgggattaaaacgattgaagagatcaaacatcacttgcaatttgttgatggcgtgatggttgggcgtgaagcctatcaaaatccgtctttgcttggttatattgatcaagaactgtttgacccaaacgccgatattgttacaccaaaacaagccgttgaaaaaatgctaccttacattgaacagcaactttcacaaggcgtttatctcaatcatattgtccgccatattcttggagcattccaaaactgtaaaggggcaagacggtggcgtaggcatttaagtgaaaatgcgtgcaaacaaggggcgggtgtagaagtggttgaacaagcattatcttttttgccttactagttgcaaaatctattaaatacttaacgactcaggtgcttatggtttattgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacattagcaaccattttgtctactatgcccctttatctactataccggattaaccattaatcatctaagaaactgcgtagagtttcggaacggctagggtggcggagcttgcgtaacgcttttgcttcaatttgacgaatacgctcacgagttacatcaaattgtttacccacttcttcaagggtgtgatcggtattcatatcaataccaaaacgcatacgcaatacttttgcttcacgaggtgttaatccctcctctaatacagcattcgttgcaattcgcaaactttctgctgttgcagaatcaagaggcaactcaagagagctatcttcgatgaaatcccctaaatgtgaatcatcgtcatcccccactggtgtttccattgagattggctctttagcaattttgaggactttacgaattttatcctctggcattcccattttttctgctaactcttcaggtgttgcttcacgtcccatctcttgtaagcattggcgagaaatacgatttaatttgttgatcgtttcaatcatatgcacaggaatacgaatagtacgagcctgatctgcaattgagcgagtaatcgcttggcgaatccaccaagtcgcataagttgagaatttataaccacggcgatattcaaatttatctactgctttcattaagccgatgttaccttcctgaattaaatcaaggaattgtaaaccacggttggtatattttttagcaatagagataacaagacgtaagttggcttctaccatctctttcttcgctttgcgtgcttttaattcgccatctgcaatgcgtccgccaatttcacggatttgcgtaatggttaaacctgttgtttcctcaagtttctgcaagtttgcgatatttacacgaatattatctacatagttggctaattttggcacaccaccctttttagcattgatcgctttatcaatccacgcctcagataattcattaccttggaatactttgatgaaatccgtctttttcatgcctgcatattctacagcatagcgttgaatttgacgttcttctgctcgcacttgcttcatcattttttgcatcgtttccactaacaaatcaaattgttttggcactaagcgaaattcacggaaaatatcggaaagtgcttgaatttgatctcttgaacgcttgctagtacgtccatgtttttggattgcttgtaaggctttttgatgttgctcttttaatagcgtaaatttctcacgagcaagttctggatcaatgctattatcatcaccaccatcgcctgatgattcaccatcttcactttcatcatcaatatctgcaacggtatcactttcgctttcttcatctagatcggcatcgaggtcatctacaggggtactttctaccgcattcggatcaacgaaagcggttacaagatcggataaacgtacagtgccttcttcgacttgatcataacgagcaattaattcacttaaggcctcagggtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattccttcttcaatgcgttttgcaatatcaatttcaccttcacgtgtaagcaactcaaccgttcccatttcacgcatatacatacgaacaggatcggtagttcgaccaatttcagattctaccgtagaaagtactttagtcgcctcttccactacgtcttcatcggcaatattgcctgcaagcatcaaatcatcggcatcaggggcagtttccagcaccttaatccccatatcgttaatcatttgaataatgtcttcaatctgatctgcatcgacaagttcttctggtaagtggtcgtgaacttctgaaatcgttaagtatccttgctcacgcccttgagcgataagaagttctaactgagattgttgttcttctaattgagagtattgttccatagctttatccgttcttaagagcaaaaataagtagtggattataccactgcttgaggtgcgataaatagttttgcaaaaatttataagtatttgaccgcttaccgcccagtcaataacatcattaattcctgtttttcctgctgatttaaacctgttgtacgatcttttgccattaaaatttcaatttgtcgatcaagcagtttcttatagaaaaaatcaagcgtatcaataaaagtgttttcgacattttcaggggataccaagtgatcccaatttgccagcagttccaagtggcgatagtttggactctctcgcaaatgttccaatacaccgcccatcgaaatacccagattagcgtgacaaatattgactaattccaaaaataaatcgaagcctttttcctgcaaactctgcaaaaatgtcacatcttcaggtacattttgaatcaaatgaggattttgaagcagtaacgcaatcagtaaccgcatcggtgtcctttcaatatgtggcatattgtggcgtttaggtgcagtttcaacacttttctgagacagcatcgattccaattgtattggatcaagaatacccagtttttgccccaatatatttcgtaaatacaaacgtaacatttcccctggaatacgcttgatcaaaggtaatgctaatgaagcgagcttagattttccttctttagtggaaagatcgacctgagtaagcaaagaatcaaataaaaattcactcaatgttaatgcttgttccaaatagcgttcaaacccctcttttccctgaacgcgaataaaggtatcaggatcttccccatcgggtaagaagataaattttatctgtctgccatcgtgtaaataaggcagcgcattttctaatgctcgccacgcggcatctcgccctgcacggtcgccatcgtagcaacaaatcacttgttctgttgatctgaacatcaacttaatttgttcacctgttgtcgctgttcctaaagaggcaacggcattattcactccaaattgagctaaagctacgacatccatatagccctcaactacaaataaaaactcaggtttttcattatgttgtaaggcttgatacaaaccataaagctcattgcctttatgataagtggcagattcaggggaattaaggtatttcggcttttcatcgcctaatactctcccaccaaaagcaattactcgcccacgcttatctcgaatcgggaacatcacacgattacggaaacgatcatacacattgccacgatcatttttagagagcatacctgtatcaagcaacttttgaacttcttcaggattatttccaaagcgacgaagcactgcgtccatcgcattcggagaaaaaccgatttcaaagcgatcaataatctcttgagataaacctcgttgctgcaaataggcttgactagcactatcttgcgttaattgctgttgatagaacttagcgaccaaatctaacaattcataaagattacgccgagttttataactggcttgtggtttgccatctctattgatcacattttcacgaggcacttctaacccgtgcaatgcagcaagttcctcaattgcttcaggaaactctaacttgtcatattccattaaaaagctaatcacattaccgtgtacgccacaaccaaaacagtgataaaactgtttagattggctcactgtaaaagagggacttttttcgtgatgaaaaggacaacaggcttggtaatctcgccctgcttttttgagtttaacacgactattgatcagctcgacaatatcggttcgagcaacaagatcatcaataaatgaacgaggaatagagcctttcattgattatctccttgctagcaagcggatagttttgcaaatttttttacaattcagaccgcttatgatggacggtataaacattgaaaccgtgattccttaaaggtttcacggttccaatttaacttctgctacctaatttaaaattagtataaacgagtgttacgcgcgttctcacggaagttacgtttagcatgacgttttgctaaagacgctttttcacgtttacgaattgtagttggcttttcatagaactcacgagcacgaacttcagctaaaagacctgctttttcgcaagagcgtttaaaacgacgtaatgctacgtcaaatgattcattttcacgaactttaattactggcataagccatcacctcaggaaatatatgtttaaatgaagccgcacaaattggtggcggcatagaactaaaaaaggtgaggcattttagcttagactaactaataagtaaagagcaccttatcaaaataatctacaaacatacagcttttccaaaataactttactttggtattcactgaacaataatcttggaaccattagaaaatacgatgtctcttgcctcataaattgcatttaatgcaatattatttctaaaactatcctgtatattctgaggcaaagtatccaatgaaatagaaaaccattttcctatatatttacaatcttactccatcaccaactggtaacttggttttagaaaacatgtataaaaacgaagtatgtatctataaattcttaaaaatacttcaatacttttattcttgcaaagaaaaaataccgattttctaataatctcaaaaaccggtatttacataaattactcctcaatatctaaatatcaatcttattgaatttggtttatagagaagtatatttcatttcaattatacgaaatggacaaatattatttagtatctatgactggtgttgcttcttcagtctgagaagacactgcgtcctttatcccatccactttagtttcaactaattgttttacctcttcaattggatgagatactgcatcttttaacccgtccactttagtttcaactaattgtttagtttcttctactttagtttctgttgtttgttttacctcagcaactttctcttttgcttgatcacaagcggttaaagaaagcgttgctgtacctaaaactaaagcggttaataaagattttttcataaaaataattcctataaattaaggtttaaattgccacatttagagtaaatacttaggaattagttccctaagcatttacaagtgattaaagatcaaccttttatttttgcaaccctcggtgcagaataaacgtggctcactgcactactatgtccgccaaagccttttccgtagaaatagtattttgagttctgccactcttttgcttgaattaaggcaatttcttccgctggtgctgctgcaaccgtcatttctacttgcgtatgtgcaacacgagagaatgtgcctagtttcccttcaaactgatattgactttgataaaccttaatcggttctggaatcggagctgcaactttctgctcagattcgaccgcttgaggccctagctcttccaatttaatatggcgacgttcgtgattttctttaactaaatctcggttagtcggttgagaaaccacaagtccgaatggtttagccgataaagccactgctttcggatcaacttctgcggattctgcttcaactttcgtacgacgtttgtggttgtctttgactaaatcacgatctgaactttgagttacgaaataaccaaatggcaccgatgaatcttgatgagcctgagtgttagcttcctcttttacgggttcagctacttctcttgctacagattgaactggctgttcttgctgttgtaacatctcatcaacagataagaaacgaggtttctcttccgcaacagcttttggcatttcgctaaatttaatccaaaccttaccgcttgcaagttcaggcgaagcgacagccgaagttaatggcattactgcttttacttcctcacgacgctcacgacgacgctgattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcctacgcgtaaatggcgaggtaaacggcgttggcgaggctcacgttgctctgtacgctcttctactacaggctctgaagtttccaaaggcatctctgcatttactgtagtcaccacaggctctgccacaaatgaatcagccgcattctcttctgctggtggtaaagaagcggtaatttccgctgaatgttctgcagtttcaattcgcactttcttacgtaagtcacgacgttggcgacgctcagccactttcgcttcacgctgttgcggaactgaaacacctgccacttcttctacaatttcacgacgtttcttaggctctactggaacgacttcagcttctttcgttgcttcaacgaccgtgtttttacgctcttggcgttcgttgcggtttggtttttcacggcgttgctgacgacgttcacgctggttacgagccttacctttaccttgcttcttctcaggttctttctcttcgcttgcaaacattgctttgattttcgcaataattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggctcaactggtgttggtgcaggctgtaaatttaactctgaactttgtaatactgattcaacggtaatcactggcttattacggctaaccaacgcttcttccgaatggtgatgatgaatgtgattttcttcatcttgttcttggtagcgtttcgctaaatcgtaacttaaggttggaacgatctcattctcacgcaggcgatatacgctaaagtgtggggtttccatactttcggttggtacaacaatcacttggacatcgtggcgtttttcaatgtcgctaatcgccttgcgtttttcatttaataagtacgaagcaatttccacaggcacaatagcgtgaacctgtactgagttttctttaatcgcttcttcttctaataaacgtaaaatggagagtgcaatcgactcgttatcacgaatttttcctgtaccttgacagcgagggcaaacgtgtgatgacgcttcacttaatgatggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcttctaagttggtatttaatgctgtttcttcaatgtctccaccacgggtcgcacgagatgagttgatgtcgatagctgtcaatgcttcggttacatcaatcacaatagaaccgcctgacggcaaacgcacttcacgttggaatgctgattcgatttgggattcgatttgatagtgactgaacaacggtacttcaccttcatacaggcgaacacggttgataaaatcaggacgcacaaggcggatatgattttttgctttctcaaataccttacgattatcgatcaaaatctcaccaatatcacgacgaagataatcacggattgcacgcacaatcacatcactttcttgatgaattaagaacggtgcagggagagattctgccgcttttttgattgcctcccagtgatgtaataaaacttttaagtcccattgtagctcttcaggggatttacccaccccagcagtacgcacaattaaacccacatcttcaggtacatctaagcaatctaacgcttctttcagctctaaacgctcgtccccttcaatacgacgagaaataccgccagcacgagggttatttggcattaaaacaagatagctaccagccaaagagataaaggtcgttaaagccgcccctttattaccacgctcttccttgctgacttgaacaataacttccgccccttcttgaataatatcttttatgtttgggcgaccttggaatacataaccttgagggaagtattcacgagaaatctcttttaacggaaggaaaccgtgacgctctgcaccgtaatcaacgaatgctgcttcaagactgggttcaacacgggtaattttacctttgtagatattcgctttcttttgttcgtgtcctgggctttcaatatccaagtcgaacagtcgttgcccatcaacaagggcaacacgcaactcttctttttgagttgcattgattaacattcttttcattgtgttttctcattttatttttgttagtgctattcatagggttcgggtttgtatttttgctaatctgtcaatctcccgactgtctaaggacaaactgacgtgaaccctatgatctaaggtgatctgttttatgtcttacactcaaaatctgaccgcataatcaatcacgatatttgcatttttaaccgttgcaagcggtacttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtacttttgtctgattttctacaattttattcagtaaaattcaatagacagaaaaagcgagtcattatggcattttaagagaaaaatagaaaggcaaaagtaaataacgtaccataaataacattgaatgtattttatacaatgtttgcggctactaacgaaaaaggtagtctctctaataacttctgatgaatcccgccaaatgccccattactcatcactaaaatatgatccgttggtttagcttccttgacaatcaattccactaattcatctaggcttgtcgaccattgtgccggctggcttagtgcatctgtaatcgtgctgacttgccacggaatggtatcgggttgataaacaaagacggcatcagcgtctttcaacgatggggcaatttcctctttgtgaacgcccattttcattgtgtttgaacgaggctctaataccgctaaaatgcgttgttctttacctactttgccacgaagtgcgtcgatggttgctaaaatagcggttgggtggtgggcaaaatcatcataaacggtaatgccattcacttcccctttgacttctaaacgacggttggcattgataaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtttaaacctaaacaggcttgctcaacgcttacccccgcgtgatgtgctgcggcaatcgccattaagccgttgtgcatattgtgagcaccaagcaagttccatttcacttctcctgctttttgctgtttatggtaaatcgcaaaatgagaatagtctgaacttaacggctctgcaaaccattctcgatcttgcccaataaattgttgctcgctataacagcccatttttaaggtgttttggacattttcatctgatgttgcagacaaaatgcagccattttgtggcattgtgcggataagatgatggaactggcgttgaattgcttttaaatcatcaaaaatatctgcgtggtcaaaatcaatgttattaataattaaagtttttggattgtaatgtacgaatttagaacgtttatcaaaaaaggctgaatcatattcgtccgcttcaatcacaaagaaatcgcttgatcctgcacgagcagaaataccaaagttgcctgccacaccgccgattaagaaacccgtatcaatgccagcttgatctaaaatccagcttaacattcccgttgtggtggttttgccgtgtgtgcctgaaacggcaagcacccaacgatctttgagtaaatgatctcttagccattgtggccctgaagtgtatggcaagcggtgatttaagatatgttctacgcaaggattaccacggctaatcgcattgccgataataatcatatcgggaacaggatcgagctgtgcaatatcgtaatgggggataatttcaatgccacttttttccaaaaaggtactcattggtggataaacattggtatctgaccctgtgactctataacctaactcccttgcaataatcgccacgccacccataaaggttccacagatccctaaaatatgaatatgttgctgtttcatagcattccttacataaaaattgtgaacagtatcacaaaacaaaactttactcgaaaacagagcttcaatgggcgagtataataaagcaaactgcattgaatagctaataaggagataaaaaatgaaaacattaggcgaatttattgttgaacgccaagcagaatatccaggagctacgggggaactcagtggtattctatcgtccattcgtttgtcagccaaaatcattcaccgtgacattaaccgagcaggtttaacccaagatattttaggtgtatctggcgatgaaaacattcagggcgaaacccagatgaagctcgatgtatttgccaacgaaacaatgaaaaaagcattaattgctcgtggcgatgtggcaggatttgcatctgaagaagatgatactttcgtggcgtttgatacagaacgtggtcgaaatgcaaaatacattctaatgacagatccccttgatggttcgtccaacattgatgtgaatgtgtctgtcggaacaatcttttcgatctacaaacgtgtatcaccgattggtacaccagtgacgatggatgatttcttacagcctggacgtaaacaggttgcagcaggctatgtgacctatggttcatcaacaatgttagtttatacgacgggtaatggcgtaaacggctttacctatgatccttctttaggtttgttcattctctctcacccaaatatgaaaatgccgtttgaaggcaaatattattcgattaacgaagggcaatatctcaaattcccagagggcgtgaagaaattcattaaattctgccaagaagaagataaagcaacggggcgcccatactcttctcgttatatcggctcattggtttcagacttccaccgtaacttgttaaaaggcggtatctacatttatccaagtacgaaaagccacccgaacggtaaattacgcctactttatgaaggcaacccgatggcatttttagctgaacaagctggtggtatggcgacagacggatttaatccgattttagatattaaaccgacagaactacatcaacgtgtgccgttctttgtgggttcaacagcaatggtgcaaaaagcgggtgagttaatggctgaatttcgctagtaaataatggaaagaaactcaccgcttgtttacgcaagcggtgagttttttatatcattttgttataaagaccacatttttgttctttaccttcaataaaataatcagtatcttactcgcaatttttcactctttattggagatattatgaaattaaatacaaaattctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaatacaaaattctctctcttagctgcaacgttattggtttcaaccgttgctcaagccgcagataaaacgttcattaactgtgttagccgttcaccaacaggctttagccctgcattagtgatggacgggatttcttataatgcaagttcacaacaagtgtataaccgccttgttgagttcaaacgtggttcaacagatattgaacctgctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggagagtgagtgatgatggtttaacttatacctttaatttgcgtaaaggtgtgaaattccactcaaataaagagtttaccccaagtcgtgattttaatgcggacgacgtagtattctcatttcaacgtcagttagatccaaatcacccatatcacaatgtatctaaagcaacttatccgtacttcaaagcaatgaaattcccaacattgttgaaatcagtggaaaaagttgatgaacatacagtgaaaattactttaaatcgccaagatgcgacattcctagcaagtttaggtatggacttcatctcgatttattcagcggaatatgcagataaaatgttagcggcaggcaaaccagaaaccattgatacaacccctattggtactggtccgtttgtgtttgcaggctatcaagtggatcaaaaaagccgttatttagcacataaagagtattggaaaggaaaagccgatattgaccgcttgatctttgaaattgtccctgatgctacggctcgttatgcaaaattacaagcgggtgcttgtgacttaattgatttcccaaatgcagcggatcttgaaaagatgaaaaccgatccaaaagtgaatttacattctcaagaagggttaaatatcgcatatattgcgttcaatactgaaaaagcgccatttgataatgtgaaagtacgtcaagcattaaactatgcggtagataaaaatgccatcattgatgccgtttatcgtggagctggtgttgctgcgaaaaacccacttccaccaacaatttggggctataataacgaaattacaggttatgaatatagcccagaaaaagcaaaacagttattaaaagaagctggctttgaaaatggttttgaaacggatatttgggtacagcctgtggtgcgtgcttctaacccgaacccacgtcgtatggcggaattagtgcaaagcgactgggaaaaagtgggcgtgaaatcaaaactggttagctatgagtggggcgactacatcaagcgtactaaagcaggtgaattaacagctggtacttacggttggtcgggagataatggtgatcctgataacttcttatcgccattattcggtagtgaaaacgtgggcaacagtaactacgctcgcttcaaaaatcctgaattagatgcgttattacacaaagcggttggtttatctgacaaggcagagcgtgccaaaatttatgaacaagcacaggtattgttaaaagaacaagccccttggatcaacgtagcacactcaattaactttgccccaacaagtaaacgtgttcaagactataaacaaagcccatttggttatacttacttatatggtacgaagttggcggattaatctgtcttaacaggaaagggaagcaataagcttcctttttcatttcattaccgatgagaagataaatcagctataattcttcccaaaaataaagaaataaaatacacatcttaaataagggagaatatatggaaattaaatcgtcacggaaacgcttaaccctcaatgatattgcacaacttgcgggtgtatcaaaaaccacagcaagtatgatcttaaatgggcaggcagaacaatttcgcattaagcctgaaacccgccaaaaagttgaagaaatcgcaaaacagcacggttatcgtgcaaatgcttatgcaaaagcacttaaactacgtcgcaccaatgttattggtctggtcattcctgatttaaccaattatggctttgcctctacagcaaagactttagagaaattgtgccgagagaatggtttgtacttagtcattgcttgttctgatgataatcctcaacaggagaaacaagcgatagatcgtttacttgaccgtcaaattgatctcttaattaccgctccaacacatcaagatccaaaatactataaatccgtattaaagcacactcttctattacaacttgaccgctatgttcctcaacttgaattaggttatgtgattagtgctgataccgaaaaaattgcagaactagtatctctaacgatccaacgctatcaacttaaagaatatttttattttggcggtcaatgctcactttctcctagtgaatctcgtttagctggttttcgccaaggcttaaagcaaggtaacttacaagaagaaagcggttggattttacataaaaattaccaacctgaatcaggttatcagttgatggcagagctggttgaacgtttagggcgtttgcctgaagcagtatttaccgcgtcttataccattttggaaggtgttctacgttacctcactgaacacaagcaaatggataaactgttgaacggtcaattacatttagccacttttgatgatcacgatttacttaacgctctgccgtttcatattcattcgattaaacagaatcatcaacaaattgcattttcgctgtttaactgagcagttaaaagtagaatgtgaaattatttggagaagataagatgattacaagtatagcctagatttttctccctacaataatagttaatccattcttgtcttactatattgtaaacaaaaatttccaaaattcttttttcggagtatcataagcggacagatcaaaggcttattttacaaaaggaagagaagatgcgatttgcgattgagtgtattgaacgtgtgggcgttgctcaagatattttaagtttattggcaacgaaaggcataaatttagaagggatcgaactgcaaaaattaggcgaaaaagggcttgtttatttgcgtactgaagcaatggagactagccagcaagctaattttgtcaaacagttgaagaaaattccaagtattactgccgttcaagaaattcatcatcttccacaagaacgtaaaaatcttgagttgagagccttaattgaggcgttgcctaatcctgttttatcgcttgatctcaacggtaaaattgcctttgctaattctcaagcctgtaaagttttattaccgatttatcgccagtcgctacctaagaaaaaacaagagcaaattctttctcttgaaggcgttgatctcaacgaaattatcgtcaatctcaatcgcaccaaatggtatcagtgggttttgcaacaaggtcgttctattttaccgacaacgttacagccaatttctcaccctattcaatttaatgatcaagtatggcgaatggatttactgccgattgaattgtgggaggcggcacaaaaccgaccgcttgggtatgttgttaccctgcaatctcagcaaacaatgcaactcgatttacgtcaatttatggcaaatcaaaacagtgatttcgatcatattttgacgaagagtgccaaaatgaaagcggtgattgaacaagccaagaaatttgcgacactcaatgtgcctttgcttattcaaggcgaaacgggaacaggtaaagatttgtttgccaaagcgtgccaccaatttagttttcgtcgggatcaaaaattcattgccgttaattgtgctggattgcctgaagaagaggctgagagcgaaatgtttggacatcacggtggcgaccgtacgcacgttggcttttttgagtatgccaatggcggaacagtattgctcgactcggttgcagaactatcccttgaaatgcaaggcaaattattacgttttttgaatgatggatcatttcgccgcgtaggtgaagataaagaaattcaagttgatgtgcgtgttatttgtacatcacaaaaaccgcttgcgaccttagttgcggaaggaaaagtacgcgaagatttataccatcgcttgaatgtgcttaccttgaatttaccgccgttgcgtgaaagacaaggggatttaatgctactgaccgatcactttattacccaaatcagtcagcaactaggcattcgtaaaccgctttacgatgaacattttatcaaagctatgcaagcctatcattggtctggaaatttacgcgaactttataatgcaatttatcgagcttgctctttagctaccgatcaacttaaatcgagtgatcttaacttgcctgaaacggtaccaagccattttgaaatttcacatttagagcaaggttcattagaagagctggttaatcgttttgaagcctcactgttacgcaagttctatacggaatatccaagtacgcgtaaattggctcaacgcttaggtgtttcacatactgcaattgccaataaattgcggagttatgggatcagcaaatgatgaaacaacttatgctatggggatttgcatttttaggcacatatcttaccgcttacgcatctcctaaaattccacaagcgttactgacagacagtctggtttactgtaccagtgcctctggtttttcttttaatcctcaaaaagccgatgttggttcaaatatgaatgtcgttacagaacagatttacgacaaactgattgaatttgatcccgaacaaaaccagctgaagcctgcccttgcagaacgctttgaaatgagtgaggacggtttaaccattacgttatatttacgcaaaaaagtctcttttcatcatacaaaatggtttacgccaacacgctatttgacaagtgaagatgtgatcttttctttaaatcgaattttaggcaaagttggggaactgcctgagcttaatcgagaagtacaacatcaagttcgtcaccgaattgcagaccgcacccatttctcttattttgaaagtgtcgatcttgctaatcagatcgtcgagatttcagcgccttcatcgcatatcgttaaaattcgtttggcacagcctgatagctcaattttggctcatcttgccagtcagtatgcggtgattttatcgaaagagtatgccttacaactcaatgccgatgataatttaatgcaactcgatattctgcctgttggcacgggggtatatcagcttgataattatgtacaaaacgattttgttcgcttacagcctaatcctcgctattggggcaaaaaagccaatatcagtaatttagtggtggatttctctacctctggcacagggagaatggcaaagtttttgaacaacgagtgcgatatttctgcctttccagaaccaagtcagctctctattttggataaaacgcaaggctatgtaattgaaacggctggggcaaaccttgcctttttagcctttaatttccgccaagataaaatgaaagatccagcattacgccaaaaaattgcgacaagtattgatcgtgagcgtctggcgcgtattctgttttacggcgttgctgaagtaccacaaaatgtactgccgaaggcgttgtatgcgcaagaaaatccaacaagctacccttattatccgcctgatacgagtaaaaaaatggaggaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgccaagtgagccgagcctacttaactcagcaacttgaaaatcatcaggcagattatgatttaattctaagtggttggttagccaataattttgatcctgatagttttctctcttcgattttaagttgtcgcttgcaagatgcggtgaccaatctatctaattggtgtagcgtggaatttgatgaattgcttaaattagcaagaaccgctgaagatccacaaagccgaatgcaatattatcaacaacttcaaactctacttgaagaacgcttaccgctgttacctttggtgaatgtcaaacggttgttagttgccaataacagcgttaagaatgtcaaaatcagtgcgtttgggcaggttaaattatctgacattaaggtgaaataaaatgttgttcgttcttattcgtaagctcttgttaatcatcatttcactgatgattttatcgcttatcagttattttattttgctgagaaatccgcattattctgtcattgaacaagacttctcaggctatgcaatttatttgcaacaattgcttgaagggaatttaggcgttagcgaaatgacaggtgagcctttaacgaaattaattttaaatgtctttccagccacgatctcgctctgtttatcggctatgttactttcgctgatgctaggcattccgcttggcttttttgcggcgctacaacggcaaaatatgattggcaaactgttaggctcactggggtcattaagccttgctgtgcctgtattttggcttgccattgtcttattggcgtatgcttctagccatcattgggcaatttcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccatcattgggcaatttcagctgtcggcgaactccaccccatttatgcggtaccaacaatcacaggcgttaaaattttagatatttttctttcagatgcaccatataaattaaaaatgatgcaaagcgccttgcatcatcttgcactgcctacccttgtattagccgtgccagcgacgttagaaattatccgaatgacaaaacaacgtacggaatatgtgctgaaacaaaattatgtcaaagtcgctcgtacacgaggctggtcgccacttaaaatctggtgggtgcatattttacgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttccgcaggcgtgcttgcgattggtatttttgttctcagtgtggatttactggcaagcctattaactaccctacttgacccatcgcagaaaaaagattggtatgtcaaggtataagaaacaatggggacttttaggggtgctatatctcgtgctgttaaacattttttactctgctaatacgctttgttttctgcatttaatttagaaaataaagtttgttgtgtctcattgtatctactcattcttccgtgcatttgctatacttttatccctttaatttatttattcatcggatactgtaatgcaattaaaatcctacccagcgccaacctacgcacaacgtgccaaaatcgcgtttcaatatatgatgccacagctatatttaacccaaaccgcaggctggctggcggaacgtaaatggggggcaatcactcatttcatcatcaatgtttttgcgaaaaaataccaagtcaatttagcagaagccgaaaagactaatgcttctgattatgtatcatttaatgaattttttattcgtccattaaaggaaaatgctcgcccgattaaccaagatccgcaagcactctgtttacctgcggacggttgtgtgagtgagttgggtaaaattgaagagaaccaattattacaagcgaaaggtcaccaatttagtttagaaacattacttgctaatgatcttaatctggcagataaattcaaaaacggcaattttattaccacttatttatcgccaagagattatcatcgtgtgcatatgccgtgcgatgcaacattgcgtaagatgatctatgtgcctggtgagctgttttcggtcaatccatttttagcagaacacgttccaaatctttttgcgcgtaacgaacgtgtgatttgtgaatttgaaacggcatttggtcctatggtgcaaatccttgtaggagcaaccattaccgcaagtatgagtactgtttgggctggagtaatcaatccgccaagagcaaaagaggtgacggtttatgaatatctcaccacaggtgaaaccgcagtacatctgaaaaaagggcaagaaatgggagcattccgtttaggctctacggtgattaatttgttcccgaaaggtgctgtggagttggaagctcacttaaaagcaggcgagccgaccaaaatgggtgaacgtttaggtaaaatcaatctctaaaagtggggcgttcatatacgccctttgttatgtgtaaggaaaacagatgaaagccaagttacttattccactgattgtttttttagggttaattattacctttactattcagcttcaacgcaatgccaatggagaagatccaaaagcacttgagtctgctctcgtaggtaaaactatcccagaatttaagttagagtcgttacacgaagcaacacagatgttagattcatctgtggttaaaacaggaacgccacgcttattaaacgtatgggcaacctggtgtccaacttgttttgctgaacaccaatttttaactgttcttgctaaacaaggggttgaaattgtcgggatagattacaaagatgaacgtgctaaggctttaaaatttttaaaagattatggtgatccttacaaagccattgtttatgatccaaaaggctctttagggttagatttaggggtttatggtgcgcctgaaacctttattattgatggtaacggtaaaattcattaccgccacacaggagatgtgaatgaaaaagtgtggaatgaagtgctaaaaccaatgtatgagaaattgaagtaatggctatgaagaaattatttgcactcttattgcttgtctccgcattaagcatagcttcgacggatattcagcaatttgataatgcacagcaagaatctgattatcgtgcgttaatccaagagctacgttgtccccaatgtcaaaataacaatattgcagattcaaatgcaaccattgcgacagatatgcgtaacaaaacccttgagctattgaaacaaggtaaaagtaaagatgaagtcgttggctatatggtggaacgttatggtaatttcgttacctatgatccgcctatcacaccagcgaccattctactctggcttatgccgttattattagttggggtaggtttaggcattatgtttaaacgtaaaaagcgtgtacaagcggtcagttctgagcagaaaaatgcaaatgtggttgatacagctcgccttaatcagattttaaacgaaaaggataaataatgaatttttggattttagtcacgattattacgctgattattggcgtagtggcgttctaccctttattgaaacagcgtcaaaatttaagtgcacaaaagcgtgataacctgaataaggcattctattttgaccgtttaaaagaagtggaacaagaagcggcagcgggaattattgaagatagcgagcagacgaagctcgaacttcaacaaagcctgcttgatgatattcctgaacatcaagcacaagcggtaagttcggcgaaatcatttggacatcttggcaaattatggtttatcaccttgatcttattgattggcggtattagtgctgggatctattggaacatcggttcgtggtttagtggcacaatgcttgaaatgagccacaaaaagcttgattatttttatgaaagagtaaaaacggaagaaaccgatcccctttcagaacaagagctgaaccaatttgcaatggcactgcgtgttgagctacaaaaaaatccgaatgacgataaacattggtttatgttgggtcagttaggaatggcgttggataatggacagctagctcttgatagctttgctaaagcgagcaaactaaaaccagagaatatgcagtataagttacgccacgctgaaattttattgttctctgaagacccaaaagataaatcacaaggtgagttattgctcaaagaagtgattagggcagatcatacaaataccaatgccttgagcttattggctttccgtgcgtttgaacaggaagactataaaatggcggcaatgacgtggggaatgatgttgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtggggaatgatgttgaagctaatgcctgaagatgaccctcgtcgtcctacgattgagcgtagtattcaatctgcgttgtcgatgataaaatcaggagaaataaaaaccccctaactcaccgcttgttattttatagactagatgtaatgcaaaaaactctcgcaatttttttaatgggaccaacagcatcggggaaaaccgatcttgccattgccctacgtcagcagattcctgttgaggtaatcagtgtggattccgccttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcagtgtggattccgccttaatttataagggtatggatataggcacggctaagccgagtaaggctgaactcgaacttgccccccatcgtttaattgatattcttgacccatcagaaagctattcggtaatgaattttcgtgaagatgcgttacgagaaatggcgaatattacggctcaaggtaaaattccgttgttggtaggcggaacaatgctttattacaaatcattgcttgatggtttatcgccattgccttcagcagatccagctattcgggcagaaattgaagcaaaagcagagcaaatcggttgggcaggtttgcatcaagagctggttaaaattgacccgatttcagctgagcggatcaaccctaatgatagccagcgtattaatcgggcgttagaggtcttttatatttcgggaaaaacaatgacggaactcaccgctcaacaaggcgaaggtattccttatgagataatgcagtttgcgatagcccctcaagagcgtgccgtgctacatcaacggattgagcaacgttttcataaaatgatcgatttaggctttgaacaagaagttcgacagctttatcaacggggcgatttaaatgttgatctgccttctattcgcagtgtcggttatcgacaaatgtgggaatatttggaaggacaaacttctcttgatgaagcaatctttaggggcatttgtgcaactcgtcagctggctaaacgccaaattacttggctaagaggttggacgagtgggttggaatggcttgatagtttggatcctgaaaattcttataaaaaaatgatcgaaaaagtacagcaaaagcatttgaaactgtggtaatatcgcaatgcctttggcaaagcattaaacaacaataattagaaggaacataaaatggcaaaaggtcaatctttacaagatccatacttaaatgcacttcgccgtgaacggattccagtttccatttacctcgtgaatggcattaaattacaaggtcaaattgagtctttcgatcaattcgttattttattaaaaaacacagtgagtcaaatggtttacaagcacgcaatttcaaccgttgtgccagctcgtgcgatttctcacaacaataactctaaccacgctcatcaagccgcaccagtgcaatctgctgaagtggtagagaaagtggaataattttattactacgttagacctcttgaatgaaccaaacacagcaaattctgtgtttggttttccgttgcctgaaaaaacacaaaacacgcctgacaaagagcgtgctattgtggtacatctttacctctctcaaactaaagatgtagaaaatctgatggaatttcaaactcttgccgagtccgcaggggtagaggttgtcgctacattgacaaccacacgttccgcaccccatatcaaatactatgttggtcaaggtaaagcccaagaaattgcggatgcaatcaaagattttgatgcgaccgtcgttttaattaatcaccaactcagccctgctcaaacgcgtaatctacaatccctttgcgattgccgagtggtggatcgtacaggcttgattttggatatttttgcccaaagagcaagatctcacgaaggtaagttacaagtcgagctggcacagcttcgccatttatccactcgcttagtccgccgtttaggtaaccaagatcaacaaaaaggcggtgcggtaggcttacgaggcccaggggaaacccagttagaaacagatcgccgtttaattaaagtgcgtattcagcagttacaaaaccgcttggaaaaggtaagtaaacagcgtgatcagaaccgcaaaactcgtcaaaaagcagacattccaaccatttcccttgtgggttataccaacgcaggtaaatcaaccctatttaatgtgattactgatgcaggtgtttatgcggcagatcaactgtttgctacccttgacccgacattaagacgaattcaaattcaagatgttggcacagcgattttggcagataccgttggctttattcgctttttgccccacgatttagtttctgcgtttaaatccaccttgcaagaaaccacagaagcgacattgttgctacacgttattgatggtgcagacgaccgtaaaaatgaaaatattgatgcagttaatcaagtgttagatgagattgaagcattagaaattccgaccttgctcgtgtataacaaggtggatcgcttggacagtattaagccacatatcgaatacaacgatgacggcaaacctgtggcggtttatctttcggcacaacaaaatcaaggcattgatctgctatttgaagcaatgcgagtcagacttaaaaacgagctggtctgtgaaagagtactgttacccacaacaagcggtcagatttacactaaattttaccaacagcaatgtatcaaatcagagcgtttcaccgaatttggcgatcgtttagtggaaattgaagtcgataaaattcaatggcaaaagtggcttaaacaataccctgaactaacggaatttgttgagtttgcacaatgggaagcagagagttaatattgacctaaaaacaaaatatcgagcgtatctcaccgcttggttaaggaaataagatgacgaaacaattcaaattaatcggttttgacctagatggaaccctagtcaatagcttgcccgatttagccttatcgcttaactctgccttcgccgaagttggcttgccacaagcctctgaagagctggttctgacttggatcggcaatggagctgatgtgctttttgcgaaaggaatggaatggacaggaaaagcagatgaattttcacaggaagaattagcccaaattaaacgccgatttggatatttttatggcgaaaatgtctgcaacatcagcaaactctatccaaatgttaaagaaacattagaaacacttaaaacacagggctatattttagcagtagtaacaaacaaaccaactaagcacgttttgcctgtattgcaagcctttaaaatcgatcatctcttttctgaagcccttggtggacaatcgctacctcaaattaaacctcacccagccccactttattacctttgcggcaaatttggtttatatccccatgagatattatttatcggcgattctaaaaatgacattttggcggcgaaagcagctggttgtaaaagcgtaggtttaacctatggctataactacaacattcccattagtgagtctgagcctgattatgtttgtgaagattttgctgagattttgaaagtcatacgccaataactaataaggtagcatttgaataataggcatagtaggcaaatttattacccatctatcaaaaattattggcatagcagacaagagtgttgttttttgcaaactatgcctctaatgaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaagccactttttaccaacgcttttgtctactatgcttaatcatatctaatgatatcagcggtaaaacatttaataatgtaataatcattatatctgtttttgattttcagcccaccaagctgcccctattaaccctgcgtcttgggcataataagcaggaacaacatcagggcgataaatttcaggcatttcagaaaggaaatgggttactctggctaaataaccttctgctaatccaacacttccgccaagggtaattcgttgaatgtctaagttaattttgagatcagcaattaaatgagcaatcgcttttgcagatttatccactaaagcagccgcttgtggatcgcctgctctaaagcgtgcaaacacttctggcggttcgcaagggttatcccatttggctgcatcacgagcaatcgcacgccctgcagcaacggcttcgacacagccgacacgtccacagccacacacttccccatttggatcagcaaggctatgtccgatatgtccagctacgccgtttgtgccagtaaagagtttgcgatttaagataataccgccccctacacctgtcgaaacggtaataaaggcaaaattttcaatgtcatcttgacgtaaaaattcagcacaacccgctgcttgggcatcatttaacagtgtaatcggcttgtccgtgtgtttggcaacgctttgctcaagaggaaagaatgccagattgcctaaatttttcgggttaagtgcggttagaatacccttttgaataattcccgttgaagccaccgaaacctgatcaaatttccctttgaactgcgttaaaatttgtgccaaagcgctgtctagagcttctgcacttggattttgtggtgtgtgaatttgtgtacgttccgccacaatcgcatcttttccctttaaggtaacaagagcagcagcgatttttgttccacccacatcaatggctaaacaagcggtcatattaggctcctgttttgcgattatcaatggcggtcacaaaccagcttacgatatgctcaagacgagttaaagctgagccaacggttacagcataagccccattttcaatcgcaacggcagcaagttcaggggtattgtaacgcccttcagccattacacgacaaccactggcgactaaatcacgcaccagttgtacatctggctcatcaggggtttcaccgcctgtatagcctgacattgtgctaccgattaaatctacgcctaactcttggcagtacataccttctttgtagtttgagcagtccgccattgacattgcccctaactcttggatacgtcttgcacaggctttaatcgtggttggacgaacacgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcgtggttggacgaacacgatctgtaccatcaaaggcaataatatctgcccctgcgtgatacaaatcgtcaatatcttgtaagaatggcgtgatacgaacagggctgtcaggtaaatcacgttttacgatacctacaatcggcacatcaacgactttacgcaccgcttttaaattatcaatgccttcaatacgaagccctgccgctccgccaatgactgatgcttttgccattgccgctacaatctctggcgagtccatcggaccgtcatcaacaggttggcaagaagcaattaaaccattttttaattgttctaaaatttgttgtttggttaatctcgacataaaaactccattagcattaaacaaaaagaaaatttactccaaagcatacccctacaaatgaagtaatgcaatcaatagcattaaaaagtgagagatagatcaaatttttctacaaataaaaaacaaaacggtgaatttattacaaattcaccgttcaagataagtcgttataaaacgagttttaatcgattatttaaaaaattcaacggctaaacgagcaccgactttcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaccgactttcgcattatttttcaccagcttgatattcgcttctaagctcttgccttcggtcatttcaacgattttaccgagtaagaatggcgtaatatctttacctataatgcctttttcttcggcttcttttactgcggtatcaataataccgttgatataacttggtgctaattcatcttcttgtggaattgggtttgcaacgaccacgccaccttctaagcctagctgccatttcactttgatcatttcagcaatttcagttaattcttcacacgataacgccaatggtaaaccgctatcacgagtaaagaatgctggtagatttttggttttataaccaacgacaggcacacctttggtttctaaatattctaaggttgcatcaaggtcaaggatagatttcgcccctgcacaaataacggttacgcttgtttgtgctaattcatcaaggtcagcagaaatgtctaatgtggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccagcctttatgtacgccacctaatcctcctgttacgaagaatttaatacctgcaaggtgagcacaaatcattgtagaagcaaccgttgttgcccctaattttttagacgcaataatctgtggtaaatcacggcgagaaacttttgcgatccctttgctgctaccaaataactctaattcatcatcagaaagaccaatacggattttgccgtcaatgattgcaatcgtcgcaggtacagcaccgttatcacggataatttgctcaacttcccttgccattgcaacattttgtggatatggcataccgtgagaaataatggtcgattctaaggcaacaatcggcaagccttgagccataccacgttgcacttcatcagataaaataaggtagttattcataataatgctccatttcggtttctaattgagatttggttaaatttggtcgaacagtaaattccgactgaattgtatgataggcgttggttaaaccagctaagatcgccttgtcttgctcataattattaagccaagcataaataaatgctccactaaaagagtcgcctgcacctgtgacatcaatcactttgtggctatccacttttttaacggaataccaacgggtttcatcctgagatgcactcaaaatagctttagaacctgcggttaatacaatttgttttacgccttttgctaacaatattttagcggcttcttcaattttttgatcggtatctaatagcatatctaaataggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaagttcccctttattgatgattaagcaacttacaccttgtaaatcttgaggaagacgatccattttcggttcggaaacggcaatcaacaccaaaggaatgtgataaccttcggcacttttgcaaaggtattcaatggtcgcttttgggcaattcagatcagccacaatacaacgagcatttttaattaatgcagcgtgtttattcagggcttcaggggttaagctgtcataaatcgacatatccgctaagcctagatacatttcgccttctttgtctagtaatgcggtataacagcctgtagattgtccttctacggtaatcacattattcatatccataaactcagacgagaaggatttaattctctcccattcaggatcgttgccaaccgtagaaataaagctcactttctgcccgagtctgcctaaattctcagccacattacgagcaacaccgccaatcgttgttgtggaatttactgggtttgacgtataacctcgaagttcttcgtccgttttaatttttttatcaacattcgccgcaccaatacataaaatagcgctacgctcattaagaacataagctctgcctaataaatattctttttttattagggcggaaatgatgttggcaatcgctgaacgagataatcccatatattcagcgagttcttgctgtgaaatgaaagggttttgacgtattaaatctaaaatcgttttttcgttctgattcattgccgaactccattaggacaaatgttttaatgaaaggacatttgttatattattaaatccattagaaacagcgtcaatgtctttttcaaaaatttgtgaacaagctcacaaaaataaaggctgaatcctgttcagacttatagagtattgcaaaaaacttgaagaatctaaccgcttgtattattgaagtcgtttaatcgcatcaatcacgagatcccaaaaacgttctcgatctaaagcttttgccacataagtgttacattcttttggcggataacggaaatctgctaccgtcattccaagtgtatgtgttcctgttaattcaatattcacagggactttttgtgtttcaataagcgtcggatcaatcacataagctacggcacaaggatcgtgaacaggtggataatcaaacccttgggcctgtttatacattttgccgaagaagtctaacagctccaccacaaatttggctaaagcgtttcgagaaactttttccaaggtttgattgccaaccaccgttgttacagccaataaatcaatatctggattgccgtaagcaagcaaaatggcaatagcatcatcgtgtccaggatcgcaatccaaaataatttttttacgcatattatcttcctttagttcagtaaaaattaccgtgggtaaactacaataactctaactctataaggtgtaaaagaagctggcgtgaaaaaatgagagctacttcacatttttgataaataaagtccattttctgtcaatttattttttaactatgtaaaaagttaaagatcttagtttgaaaacttggtatattgtgtagcccatcatttttgatgagttagttgttataatcactataacatttatcatatatctcttctctttctttgaatggagtccttaaatgggtacgttaaatagtttattgggtatagttgttctactaggaatagcttttcttttgtcaaacaacaaaagagcaattaacttccgcacagtttttggtgcattagcttcacaaatcggtattgccgcattaattctttacgttccagtgggtcgtaatgcattaggtgcaatggcagaaggtgttgctaaagtgattagctatggtaacgaaggcgttgctttcttatttggcggtcttgttagcgataaaatgtttgaagtctttggaggcggtggtttcgtcttcgcattcagagttcttcctatcattgtcttcttctctgcattaatttcattactttactatgttggaattatgcaatgggtcatcaaaatcattggtggtggcttacaaaaagtacttggtacatctcaagcggaatcaatgtcagcagctgcgaatattttcgcaggtcaatcagaagcaccattagtggttaaaccttacatcagcaaaatgactgagtcagaactttttgcagtaatgtgtggtggtttagcttctatcgcaggttctgtaatggcaggttacgcaggtatgggggttccacttacatacttgattgcggcatcatttatggctgcacctgcaggtcttttattcgctaaaattattcttccacaaacagaaaaattcaatgacagcattgagaacgttgaattagaaaaaccagcaaacgtattagatgcagctgctgctggtgcaagctcaggtatgcacttagcattaaacgtaggtgcaatgttaatttcgttcattgcattaattgcattaatcaatggtgttttaggcgctgtcggtggctggttcggttatgaaggtctaaacttaggtctaattcttggttggatatttaaaccattagcttgggcaatcggtgttccttggaatgaagctgaagtcgctggtcaaatgatcggtcttaaattagcgatcaatgagttcgtgggttacttagaatttgctaaatacttaggccccgaagctccaatggcattaacagacaaaactaaagctatcgttactttcgcactttgtggttttgcaaactttagctctatcgcaatcttaatcggtagtttaggttctatggcaccaaatcgtcgtggtgatgtagctcgcttaggtatcaaagcggtagttgcaggttctcttgcaaacttaatgagtgctgcgattgcaggtctatttatcggaattggtggtgcggtttaacactctcaattcttgaacgaaacaccacaggaaactgtggtgttgtcgtttatggcaaagttaaacgattgctttaagtaaggaataaagaatgagtttaaaatctattgcaaaacaagccttatctttaatggatttaaccacattaaatgataatgacaccgatgaaaaagtggtaacattatgccaacaagggaatacgccatttggtacgcctgcggcggtgtgtgtttatccacgttttgtgcctattgcacgcaaaaccttaaaagcacaaggtacagaacaagttaaaattgcgactgtcaccaatttccctcacggtaacgatgatattgacattgcagtggcagaaaccaaagctgcggtggcttatggtgctgatgaagtcgatgtggttttcccatatcgtgcattgatcgcaggtaatgaacaagtcggttttgagcttgtcaaacagtgtaaagcggcctgttctgccaataatgttgcattaaaagtgattattgaatcaggcgagctgaaaacagcggaattaattcgtaaagcgagtgagatttcaattaaagcaggggcagattttatcaaaacatcaacgggtaaagtgcctgtgaatgctacccttgaatctgctcatattatgctagaaaccattcgtgatttaggtgttgcagatagcgttggttttaaagccgctggcggtgtaaaaaccaccgaagaagcagagcagtacctcgcattaactgctgaaattttagggcaagattggattaaccaagctcatttccgctttggtgcatctagtttattagcaaatttacttgctacattaaacgatgaacaagtaaatcaaaatgtaacgggatattaatctctcaacaaacaaagaggaacagactatgactccacatattaacgcaccagcaggtgcatttgccgatgttgtattaatgccaggtgacccacttcgtgctaaatatatcgctgaaactttcttagaaaatgcagaacaagtcactaatgtccgtaatatgttcggttatactggaacttacaaaggtcgtcgtatttctgtaatgggacacggtatgggtattccatcttgctcaatctatgcgaaagaattaatcaccgaatacggtgtgaaaaaaattattcgtgtaggttcttgtggtgcagtacgccaagacgtgaaattacgcgaagtcattatcggtgttggtgcttgtactgactctaaagtaaaccgtatccgtttcaaagacaacgactttgcggcaattgctgactttgatcttactttagcggctgtacaagcagcaaaagcgaaaggcatcaatgtgcgtgtaggtaacctttactctgcagatcttttctatactccagatgtagaaatgtttgatgtaatggaaaaatacggcatcttaggtgttgagatggaagcggctggtatctacggtgttgctgcagaatttggtgcaaaagcattaaccatctgtactgtttcagaccatatccgtacgcacgaacaaactaccgcagaagagcgtcaactaaccttcaacgatatgattgaaattgcgttagagtctgtgttgattggtgatcagcaaggttaattaaaggcataccccctgattgattaatctgcatttttgtgaaatgaagtattacaataatgcggattttatcataactgtgccgtaaagttctctccttcagagcggagatataagatataaacggtgtgggtcgtttcaaatctaattaatcaggtatttgttgttgcttgatgtattggtgaataatgaatgggggaaccaccgcggctgccagcaaatcgtgtttaatttcagtttcttcttttcatagatcaaatataaaatgtggaaaaatcacgctctaaactttgttaatgcaattacgcaaagactttaagttcgagataatgcccaacggcgagcaaatccgcataattaaacagttctgcggctatgctagggcatagtagacaaaatggctgctaatttcgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttaaggaatacaaacattagcaactatttcatccgcccatgtgttcaacatgagtaaaaagaatttaacagacaaagtatgtgattgatataagattcatttaaattcataacgaggaattgtttctagtctattcatctcatttatatgcacacggccccccactgttgcatgagcatcgtacttcctatttattgttactaattcaccattgtctttttttatagtaagtttaactgaatcaaaagatagatattcgctggttacaatagttgcattaccttcagatgtatatttttcagccgtacacgctactgatataatgcctattaataaaatactagataactttttcatataagccctttgtataaaataagccaattttaaagaagtgacacatttaaatcataagggtgcaacttaagacagcaaaaattctgataagttgcatttttgagtgaaattgccacacttggattaggtaaacgttcgccttcgacttgtggttggctgattttgatctttaattcgggattagcttgcaaagaaaattgctcatctatccgcttacaccactgctcaacgttctcgttttcgtacattgggataataatttcaatatgctcccagccttcttctggatagcttttacctttagggaacggcaactcaatcacggaaactgcctgtccgcaaaaatgcactggctgatttagagtaaacaaacctatcgggcgaccattaacttcactctcttttaataaggttgagccagtcagcagcattgctttccattggttagcgacttcatcactattcattcgcaccgccagatgatcgatctgatattggctcaaatcaatctgagcaatcttagcaatctgcgctatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctcaaattcagcaagttcaccaaaacaagcggttagatttgtgaaaaagtttgcaaattcggagcatttatcagtattttttagtatcattgcacacattttttagtattgaaaataggtataaacgtgaatattcaacacattctatcggaaaaaatcaagcaagcaatgattgtcgcaggggcagagcaaaatgttgagccattagtgcgtcaatcaggcaaagtccaattcggtgattatcaagcgaacggcattatgggggcagcaaaaaaattaggcttaaacccgcgtgaatttgctcaaaaagtagtggataacgttgatttaaacggcattgcagaaaaattagaaatcgcaggcccaggttttatcaacattttcttagccccaacttggttagctcaacaaacagaaaacgcattcagtggcgataaattaggcattaacttaaatcaagctcaaacggtggtggtcgattattcatcaccaaacgttgctaaagagatgcacgttgggcatttacgttccaccattatcggcgacggcgtagtgcgtgccttagaatttttaggcaacaaagttattcgtgctaaccacgtcggcgactggggaacgcaatttggtatgctgattgcttacctagaaaaaatggaaaacgaacacgcgtccgaaatggagttaagtgatcttgaagccttttatcgcacagcaaaagagcattatgatagtgatgaagtctttgcggaaaaagctcgaaattatgtggtgaaattgcaaagtggcgacgattattgccgtacgatgtggaagaagttggtaaacatcacaatgcaacaaaaccaacataactacaaccgcttgaatgtgacgcttactgaaaacgatgtaatgggcgagagcctttacaatccaatgttgcctgaaattgtggcggatctaaaagctcaaggtttagccgttgaagatgatggggcgttagtggttttccttgacgaatttaaaaataaagacggcgacccaatgggcgtgatcgtgcagaaaaaagatggcggtttcctttacaccaccaccgatattgctgctgccaaataccgctttgagaccttaaaagcagatcgtgcgttagtcttttccgacactcgccaaagccaacatatgcaacaggcttggttaatcactcgtaaagcaggttatgtgccggacagcttcagccttgaacatcacaacttcggaatgatgttaggcaaagatggcaaaccattcaaaacccgtacaggtggcacggttaaattagcggatttacttgatgaagccgttgagcgtgcagaaaaattaattgcagaaaaaaatccagatttaaccgcttgcgaaaaacaagctgtagtggaagccgtggcaatcggggcggtgaagtactccgatctcagcaaaaaccgtaccacagactatgtatttgactgggataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataatatgttgagctttgaaggcaacaccgcaccttatatgcaatatgcctatacccgtgtgcgttcgatcttcagtcgtgcagggatcgacccgaacagcttaacggccaatatcgttttaatcgacgaaaaagaacgcaaccttgcgattaaattattgcagtttgaagaagccgtgacggtggttgccaaagacggcacaccgcacgttctctgccaatatctctatgaattagcaggtattttctctagcttctacgaagcctgcccgatacttaatgccgaagaaagtattaagcaaagtcgcttgaaactcgctcacttaacggcaaaaaccttaaaacaagggttggatctgttgggtattaagacggttgagaagatgtaaggcatagtccgtaaaaaacaacacttttgtctactatgccaacaaaaatatcggcatagtagacaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcccgtagcacgatatgcaccacagggtttagagtaaaaacctattatattgccatttatgttatttatgaacttattttttaaacgatattggtttaaaaaagtccagttaaacaaatatggtcaagatggcattctaccacattaaccaaatttagaaatcaaatacttatttatgctaaggaaaagataaagatagaaagtaatgaagtggtgctgataggcggacttgaaccgccgacctcacccttaccaagggtgcactctaccaactgagctatatcagcgtttggagcgggcagcgggaatcgaacccgcatcattagcttggaaggctaaggtaatagccattatacgatgcccgctgttctaaattcgtctgtcccaaagaaattcaattaaagaaatggtggagggagaaggattcgaaccttcgaaggctgagccaacagatttacagtctgccccctttggccactcgggaatccctccacgataattgaatacttgataacgctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgcgtcgtaagcaattaaggcgcattatagggatttcgaaaaaccttgcaagcatttttttcaaaaaaattaaaaaatccattctttcgcttgttaaatacgcaaattgctgattttttagatgtttttactaaatgttgtaagataaaatatctactttcattatttctattgtatatttcgggttattaaaaccgtaacaatatgaattatattcagcaaaaatagagaacttggcaatgggcatcactaaaattacgccttttttaacctttaatcgtcagcagtgggctgcattacgaaagtcagtgccgttaaaactgaccgaacaggatttaaaaccgcttttaggttttaatgaagagctttccctagaagaagttagtacaatttatcttccacttgctcgtttgatcaactattacattgatgaaaatctcaaacgccaagaagtgttacataaattcttagacgtagaatcgccgaaagttccctatattatcagcttaacaggcagtgtttctgtcggaaaaagcacttctgctcggatcttacaagccttactgtcagaatggcctgaaaaacgtaaagtagatttaattaccacagatggcttcctctatccattaaaaacgctacaagagcgaaatttaatgaagagaaaaggctttcctgagtcttatgatattcatcgccttattgaatttgtttctgatattaaatcgggcaaacgcaacgtcaaagcccccgtttattcacatctcacttacgacatcatccccgatcaatttaatgaagttgatcagcctgatattgtgattttagaggggctaaatatgttgcaaagtggtatgaactacccacatagcccacatagtgtctttgtttccgattttgttgatttctcaatttatgttgatgctgatgaaaccttattgaaagattggtatatccaccgtttcttaaaattccgtcgcagtgcattctctgatcctaattcttacttccatcactactcaaagttaagtgaacaggaagcaatcacaacagcttcaacaatttgggacgaaattaatggattaaatctacgcaaaaacattttgccaagtcgagagcgagcaaatttgattttagtaaaaggcgaagatcacgccattgaaaccgtcaaattaagaaaatagtaatgagtggctttcagttcaaacagtttttcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctttcagttcaaacagtttttcattgcacacgactgctgtgcaatgaaagtcaatacagacggcattttactgggctcaattgcagatcctagcaatgcacgccacattctcgacttaggcacggggacagggcttattgcaataatgttagcccaacgtaccgctagtgcacaaattactgcacttgaactggaagaaaatgcgtttcaccaagctcaagaaaatgcccaacattgtccgtggaataacagaattgacgtactacaagcggatataatgacgtggaaatctaccaaaaaattcgaccttatcgtatcaaacccaccctattttgagcatagcctcgcaagccgaaataagcaacgagatcttgcaagagctgtgacttatagtcattttgattggctaaaacagtctcaacagtggctaaccccgaatggcagaattagctttattttgccttttgatgctggaaaaaaattgttggaacaaagccatttattagggctatattgtattgaacactgggaaatctgcacaaaaatcggactttcacctaaacgagttatcctcactttttcaccacaatatgctgaaatggctttgcatacattgacgatttatgatgaaaatcagcgatatactgctgactttactcagttcacagaaatattttacctaaaagtaaactctaaataatagatatgtggtaagtacgtatctatatgatacacataactagctctaaaattcccttgaaaactttcttatgtgcaccatatgatttaattttcacttcaccaacccaccgcttgcttgtaagtctgcgtggtaggaagagcggacgaaaggtccacaggcggcgtgttcaaagcccatttcgttggctttttcacggaacatatcaaattctgttgggtgaacgtaacgagctactggtaaatggtggcgacttggctgtaaatattgtcctaatgtcagcattgttaccccgtgatcacgcaagtcttgcatcacctgtaaaatctcttcgttagtttcccctaaaccgaccataatgcctgatttagttggaatatctgggaaaaccgccttaaattctttgagtagtttgagcgaccattcataatccgcacctggacgaatttctttatacaagcgtggcacgttctcaaggttatggttaaatacatctggcggattttcttttaaaatttcaattgcttgttcaacacgaccacggaaatccggcactaaaatctcaatcttaatccctgggtttaacgcacggatctctttcacacattccgcaaaatgccctgcaccacggtcaggcaaatcatcacgatccacagacgtaatcaccacatatttgagcttcatatcctgaatggtttccgccagtttcttcggctcgtctttatctaaaggcaacggcttgccgtgagccacatcgcagaatgggcagcgacgagtacaaattgcacccataatcataaaagttgccgtgccgtggttaaaacattcgtgtaagttcgggcaagaggcttcttcgcacacagagtgcaagccgtggcgacgcataccgtttttgatactttcaatttttgctgagttggctggcagtttaatcttcatccactcaggttttttcagtaattcttggttgggatcgatatttttaacaggaataatggacgttttagctgcatcacgatatttcacgccacgttccattttaaaaggtgtacccattcgataattgtcctatttgttaataatttgttgcttattatagccgagaatttgggtaaagtaatcgaccaatttaggcgaaaccttgtcgcaatcggcttcagcttcagcgacaaaatcagctaattgacacatttccaatcctgcatagccacaaggattgatattgcgaaacggtgttaaatccatctggatattcaatgccagtccgtgaaacgaacagcctttgcgaatgcgtaaaccaagcgaacagattttcttaccgtccacatacaccccaggtgcgtctggtttgggataggcattaattccataatcagcaagggttttcactacacattgttccaatgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatctcgcacgctcaaatcgttaccttttgccttgtggcgtttgatgtcgatcagcacatacataatttgctgtcctaaaccgtgataggtaatctgcccaccacgatccgattgtaccacggggatattcgttggattgagcagatgctcaggtttaccagctgaaccttgagtaaacaccgacgggtgctgaaccagccaaatttcgtcggctgtttgttcatcacggctatcggtaaaatcctgcattttgtgccaaatttcttggtaatcttgcacaccaagttggcgaatgataagttggggcataggttacaataccattctcacgccttcaattttggctaagtcggtatagagtgtttcgacttgttcgatattttcggcttgaatagtgatggatacagagtgataagtgcctttgccactctctttaagagatggattatagtcgcctttaaccactttttgtacttcgctaacgacatcatcgattaaaccttcacgagccgcacccaccactttgaaagtgaatgaacaaggaaactcgagcaagtctttgagtttttgttgtggaatatcggctaaatttacgctttttgtttcagtcattttattgtcctttatgaatatgagagcggtgtgattttgcaaaaaatttccaaaatcgcaccgcttgtttgaatggcaccctaaatgagggcaattctgataattacaaggggttaattaaacagacctttaaccgttaaaacgatccaatcccacgctttgccaaagatacctgcttcttgaacatcgtgcattacttgtaaatcaacactcgccacatctttgccattgagttgataaatcacttttccaacgacctgccctttcactaacggagcttccaaatttgttttttctagggtgtagcgagctttaagttctgctgttttaccttttggaacggtaatgtaactatcttgtaatgtgcctagttgagctttgcttaaatcaccataatacaccgcttgttcaagcacgctttgccctgctgaaagtggtttgacagtttcaaagttagcaaatccccactgtaacagttttttactttccacttcacgccctttataggttggtacgcccataaccactgagattaaacgggtattactattgtatgctgaggctacaaggttatagcctgcttgatcggtatgtcctgttttcattccatcgacattgatggatttatcccacaataagccattgcggttaggttgggtaattttgttgtaggtaaactctttttctgaataaattttgtactcttcaggcaagtcacgaatgatatgagcgccgataatcgccatatctcttgctgatgagtattgttctgggtggtctaaaccgtgtacagtcgcaaaatgcgtatttttcaaaccaaacttctgcacaaatttattcatactatcaatgaatgtttgctctgaacccgaaatatgctctgcaatcgcaacacaagcgtcattacctgacacgacgataatccctttgttcaaatcttcaacggatacctgctgattaacattcaagaacattttagacgagcctgggaatttttgtccccaagagttttcggtaacggtgactaaatcgctgtttttgattttacctgttttcaaggcttcaccaactacatagctcgtcatcattttggttaaacttgcaggtgcttggtgttgatctggattaagactggctaatactgcaccagaattgtaatccattaaaatataggtttgagcattaagttggggggctgcaatgccataatcaatatcttgagcataagccatattcacacttgaataagcaatagcacatagactgaccgttttgagtactttactttttaacatataaaaaatcctatctatttttctgaataactgaatacagtgtaacctaaacggttgagctgctgtttaacgtgttgagcttcttcagctgaagaaacatcaataatcacttcatatctcttttctttcgtgacaatatggctattcactgtcgaaatcactttctgtacttttttcgccatacgttcattcttaagttgagtgacctttaacacaaattttggctgagaaacaaccgcttgcggtgtaggttcggtatcggctttaatggcaagtgtttcaccatcccctttcactttaaggttcaacccttcttgttgtgcaatttgatagagtgcttccgcccctttcccaataatatagccttctttatctacctgcatagcttccactcgtacttttgctgtaccagcacccaccataccaatcactttagcagcacctttagataaatcaataatgcgagttttactaaatggcccacgatcattaatccgtactattacttttttgccattgcgtaaatttgttattaaagcataagatcccagcgcaagagttttatgagccgcagtataaccatttttatcaaaaatctcaccgcttgcggttctgcgtccgtggaatttatccgcataataacttgcagttccaacttcgctgtactgacgagaagcttctttacccattaccgtatgcgttgtccccttctcttgataggatttttgattatttgatattttaacgcgttctaaatctgctccttttaccccataaagtttttttgtttgattatcactaggaacggttgtttttgtacttttagtgttagagcttacagctttcttctttacctttttcttagatgttactttttttgtcgattttttctttacgataagctgcgttttagttgtttgtttctttgtatttgttgccattgtttccaatggtgtaaacattatcattgcagctaataatagcgtaacaattttgcctattttcattaaattccccttttaatcatagaatatttatttttctgctaatttatatggattgcttttctcttttcgttcacgatgaacataactcgacatcattaaaccaaaagctgccattaaggtaacataagaggttccgccataactaaacaacggcaatggaacgccaactacaggtaaaataccgcttaccataccgatattcacaaacacatatacaaataataagagagcggttcctcccgataaaattcgtccaaaggctgaggcagattttgccccaatcattaatccccttgcgataataaataggtaaatagctaataataccaaaacaccaattaaaccaaattcctcactgagtaccgcaaagataaagtccgtatgtggctcgggcaaaaaatctaactgagattgcgtaccttccatccaaccttttccttcaataccgccagagccaatagcaattttggattgaataatgtgataacctgttcctagcgggtctttatcgggatcaattaacgtcattacccttgtcttttgataatcgtgcatcaaataaaaccacattatcggaataaatcctgctagaaagacaataccagccccaataagtttccaacttaacccagcaagaaataaaacaaacagcccagcggcacaaactaaaatagaagtacccaaatcaggctgcattgcaactaataatgttggcgcaataataatcgccagagcaatactggtatcgcgtagatttggcggtaaggaacgattacctaaatagcttgccaccattaacggtacagaaagtttggcaatctctgagggttgaaatcgaataaatccaagatttagccaacgttgcgcgcccttactgatttcacctgccacatcaaccaaaatcagcaaaataatacaaaccacatataggcagggtgatactttttcgtaaaaacgaggggggaacatcgccatcacaaacattacccctaaacccagacacacttggattactctgttggtaaacattttttcactgccaccgcttgcactatataagactaacaaaccatagccagtaattgccagcaagccgattaatagccataaatctaaggcaaagatcttccaaaatcgtcctaaaaatgatgatttattcactcaattcctctgcttctgggggttcacgttcttctacaggcaacggtgctgtagcttcggtttggtgtaacaaagcataatccataatctgtcttgctatcggtgctgcggtactaccgccaccgcccgcattttctaaaataatggaaaccacaattttagggttatcatagggagcatacccaataaaccaaccgtgatcgtgtaaattcttttttaaacctttggcatcataactttgtccgtttaaactaaagacctgagctgttcctgttttacctgcagctcgatacgcagtaccagcaaaggcttttcgcccagtaccgttgctcgcattaattacgttatacataccctgttttgagatctgccaataacggcttggcacatcagaaatatcctcgtataacaacggatctttataaggaataagctcactcgacattatctctttcatcaagtgaggcgtattcactcgcccattattaatcagcactgccgttgcttttgccagctgtaacggtgttgaaatccaataaccttgcccaatgccgacagaaatagtatccccttgtaaccaagattttctataacgtttctgtttccactcacgacttggcataattccgacggactcttcagccaaatcaatccctgttttcacgccaaagccgaattttttcatccaatccgacatcttatcaatccccatatcataggcgagttgatagaaaaacgtatcagacgactcgacaatcgccctattcacatcagttctaccgtgccccccttttttccagtcacggaaacgctgtgtagaaccaggtaaaatccaaaaaccagggtcataaattgtcgtgtttggagtaatcttaccttccgttaaacctgctactgccataaacggcttaatggttgaagcgggtggataagtcccttgtgttgcacggctatacaatgggcggtcaggatcttctaacaactgcttataatctttacccgacaccccatcaacaaacagattattgtcataacttgggtttgtcaccatcgccaaaatactgctgtcagtcggatctaaaacaaccaccgcccctttctgattatccaataagttcgccacatagcgttgcaaatcaatatcaaggctcaaacgaatactgcttccagccactgcaggctgatcacgcaatttacgaataactttaccacggttattaatttccacttcctcaaaacctgttacaccgtgtaactgctcttcataaaatttctcaatgcccagcttcccaatatcgtgcgaacccgcataatttccaaatttcccttcctcttgcaaacgtttcttatcccgatcattaatcttcgcaacataaccgaggatatgggtcaaaatatccccataaggataatttcgtttaaaataagggtgaacgtccatacttggaaaacgatactgattaaccgcaaaacgagccatctgctcttcggttaaatcaggctttaataaaatcggagtataacgagttgtacgttttttctctttatgaaagttctcaatatcttgatcggttaaacccaccaataattttaattcttcaagggtctgatctaggttatagatcttctctggcacaatatacaaaccaaaataggtcaaattttcagctaaaaccttaccatttcggtcataaatcagcccccttgtcggaggcacaggcaataacttaatccgatttccatcagaacgagtttgataagaggcataatcaacaatttgcaaatgataaagatttgttagcaaaatacctgttaaagcaatcacccccacaaacgcaatcaaggcgcgacgcacaaacagatttaactctgcttgcccgttacgcaccttgtcataattttgcggttttgcgaatttaccaaacatttgccattattctcgatgataagggtgatttgttgtcaaagaccacgcacgatataaactctcagccaccaccacacgcactaatgggtgaggcaaggttaatggcgacagcgaccaactctgctctgccgccgctttacattcaggtgaaagcccctctggaccaccaatcaatagacacacatcacgcccatcattcttccagctctctaactgctgggcgagttgctctgtcgtccaaggcttaccaggaatatcaagggtcacaaccttcgcacgcccacaagctgccaacatcgccttgccttcttgctctagaatgcgtttaatatccgcattcttaccacgcttacctgcagggatctcaatcagctcaaaaggcatatcttttggaaaacgacgctgatattcctcaaaacctttggtaacccaatcaggcattttagttcccactgccactaattgaattttcatctacacccaaagtttttctaattgatacatctcacgactatcttgttgcaaaatatgcacaatcgcctgcccaaaatcgaccacgatccagtcagcaactgctttaccctcgtgagcaaacacgtccacaccagctttcttactttccacaatcaaattatctgcagtagaagcaacgtgacgacttgatgtccccgtacacacaatcatcgtttcagtaatgctcgatttccctcttacatcaatcgcttgaatatcctgagctttcagcccttcgagggtttctgttaaaaattgaactaaatttatggtcatatcttctattcagtctatcaaaaattggtggattatagcatataaaaggacgcgatcaggaaaaagtaatatgtttacaaaggtttcataagtatcatctctcttatatgatgatttaactatttacctgtaatagcaagtatctacttatcagtatttaagaaagtcataatataaatgcccacactatatcattaacacttaatagaaaaatcctattacagatgcatgaattttaaacgtacaacaaccattattaatatttttatttgacagttaaattaaattaattagaatagggtaaaaaagcattatgacacaaatgacttactctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtaccatgttaaatctctttgagaaattctgttaaaaaatcacttaattaataccctgaagtttgaaaattacccctagttatttccgaagaggttttaatgctctttccgacactctcgtctggcatactaattcaacgctataaacgtttcttagctgatgtaaaacttccaaacggagaacaaatcacaattcactgtcccaatactggagctatgactggttgtgctaatcctggagacattgtttggttttcaacatcaaataacctcaaacgtaagtatgcctatacttgggagctcactcaaactcagtcaggtgattttatttgtgtaaatacacatagagcaaaccaacttgtttctgaagcattaaaaaataaatggatccgtgaactcgtagattacgatgaaatcttacccgaacagaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggtcaagaaaatagtcgcattgatttcctcttaaaacaacaaaatttgttggactgttttgtagaagtaaaagcaactacgctactcactgaaaacggtattggaatgttccctgatacaaaaactgaaagaggacaaaaacatctaagagaattgatagcaatttcccagcaagggcaacaggcagtcattttttttgctattttacatacaggtattaaggcctttgagatagctaagaaaattgatgcaaaatacgctcaaatttttaaggaagggatggataatggggtaaaaatgttggtatataaaactgaaatgcttttctctggaaaaacaccaacaggaatagaattaattacccctttaatttagacactctaaatatttttttaaaatagcattaatcgcattcgcatagctttcagattttgtgccaaaaataatgtgtacgttatttttaacaatttgtaccacttctgcggcaccaaatgcttttaagcctttacggtcaattttatcttttgattttagttgaactcctaatcgagttaaacagaaatcaagatattctatattttctgcaccacctaatgcagtgataattttaggggcgatttcatcggcagaaagagaaagttctaccgtttctttttctgagttaaacaggtttttaataaatttgaacatagcgaactcctataaagtgaaatatgaacagcgtatattttagacctaattatgataaattctattcattttacaaaaatattggttaatattaccgcttacacttgaaactgatgatattgcccttaaatatgcacgcagttttttagaaaaataggaatttcaatgacaacgatcgtatgtgttcgcaaagatggcaaagtcgctatcggcggtgacggacaagctactttaggcaattgcgtagaaaaaggtacggtgcgcaaagttcgccgtttatataaagataaagtggtaacaggctttgcaggctcaacggcagatgcctttattttgcgtgatctgtttgagaaaaaacttgaattacatcaagggcatttagtcaaatctgcggttgaacttgcaaaagaatggcgtaccgagcgctcacttcgcaaattagaagcgatgatgatcgtcgcaaacgaaagtgagtttttgctggtttcaggtagtggcgatgtaattgagcctgaatttgatgtattagccatcggctctggtggtaactatgcaaaagctgctgctcttgccctattaagaacggaaaataatctttctgctaaagaaatcgtggcagaagcgttaaaaattgctggggatattgatatttacagcaaccataatcacgtgattgaagaagtatagtagagacacactgcgtgtgtccaaaaataaatatattgatgtgaattaacggacacacgcagtgtgtccctacaaaatggaataaaactatgtcaatgacccctcgtgaaattgtgtctgaattagacgcacatattatcggacaaaatgaggctaaacgagcagtagctattgccttgcgtaaccgctggcgccgtatgcagttgccagaagaactgcgtcaagaagtgaccccgaaaaatattctgatgatcggtccaacaggcgtgggtaaaaccgagatcgctcgccgtttggcaaaacttgccgatgcaccgtttattaaagttgaagccacgaaatttaccgaagtcggctatgtgggtaaagaggtggactcgattattcgtgatcttgctaatgtttcaatgaaattggttcgccaacaagcggtcgaaaaaaaccgtatgcgtgcgcaagatgcagcggaagatcgcattttagatgtgttattaccgccagcgaaagatcagtggggaaacgtgcaagagagcgataacacttctactcgccaaatcttccgcaaaaaattgcgtgaaggtcagcttgacgataaagagattgaaattgatgtcgcagcccaagtgagcgttgaaatcatgactccaccgggtatggaagagatgacttctcaactgcaatctctctttgagggaatgtcgccaaacaaaacgaaaaaacgcaaaatgaaaattaaagatgcgttaaaagtgatggtggacgaagaagcggcgaagctggttaatcctgaagagttgaaacagcaagcgattgaagcggttgaacaacacggtatcgtctttattgatgagattgataaaatctgtaaaaaaggcgaacacagtggcggtgatgtttctcgtgaaggtgtgcaacgtgatttactgccgattatcgaaggttcgacagtcaatactaaacacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaacacggtatggtcaaaaccgatcacattctctttatctgttctggtgccttccaagtggctcgtccgtctgatttactgccagaattacaaggtcgtttaccaattcgtgtagagcttaaatcacttaataaagaagatttcgagcgtattttaaccgagccgaatgcgtctttaaccttacaataccgtgagttaatgaaaaccgaaggcgtggatattgagtttaccaaagatggtatcagccgtatcgccgaatccgcattccgagtgaacgaaaaaactgaaaacatcggtgcaagacgtttgcacaccgtgttagaacgcctaatggacagtatttcattcgatgccagcgaacgttcaggcgagaaaatcgtaattgacgagaagtatgtgtctgatgcgttgaatgatgtggttgagaatgaagatttaagtcggtttattctttaactatatacttacagtacaaatggaaattaaaattacaaaaatatgcattacaagcggtgaaactctctcaattttttacaaaattttgctacaatctatccactcacattccatttgcaaagagatgaataatgacaaacatcagcacttttaaccgttcttggtcacgagttattttaaatgctttactccgctacggcgtaaaacatatttgtattgccccaggttcacgctcaacgcctttaacccttgaagcattacatctgcaaaaacaaggtcaaacagaatgtcatagccattttgatgagcgtggtttaggtttttttgcactaggacttgcaaaagcaacgcaagatcccgttgcaattattgtaacttctggaactgcggtctctaatctttaccctgcggtgatcgaggcgagtatcacacaccataaacttatcgtgctttccgcagatcgcccccttgagctgatcggctgtggggccaatcaagcgattgaacagcaacatatttttagtcattatcctattgcaaatctcaatttaccaaaaccaagttcgcaatatagtgcaagctggttagttggtcgtgtagagcaagcctgttctaaacaagctcaaaaaggtggtgttatccatatcaatgcgccattcgcagaaccgctttatgaagctgacgaggagagcattgggcaagatccgtggttgctcgcaattcaaggttggttgaataaacctcaggtgaaatggtacgatcaacaagcgacccaacaagatgtgttgatgcacgaaaattgggattattggagaaccaaacgtggtgtgattgtggtcggtaagttaccgcttgagcagggaatgggattaaaactgtgggctgaaacgcttggctggtgtttgatcagtgatgtgcaatctggggttgatgcctctctgccttatgcagatatttggctgtcaaacaaaacagtagagcaacgtttattacaggcagacattgttattcagtttggctcacagattgtgagcaagcgagttaatcaatttttatcggcttttaaaggcgaattctggctggttgaggaaacgacagattatcttaacacctatgctcatcaacaaacgcgttttgtggcaaaagctcaccactttacccgtgttcacccgccacttcgtcaaaaaccgtggctgttggaacctttggctctttctcaattctgtgaaacctttattgaacagcaagtgggtggcaatctcaatgaagcctctctagcacatcatatcgaacgtgtattgccagctaatggtaatttatttattggaaatagtttatttgtccgcttagttgatgctttgtgtaaattgccagaaggttatccgatctataccaatcgaggtgcaagcggtattgatggattaattgcaacccttgcaggtattgcaaaaggtagcggacagccgactgttgcagtgattggggatatttccgccttacacgatctgaactctgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcttttacgtcagattagccaaccgaccattttatttgttattaataataatggcggtgcaatttttgatatgcttcctgtcgatcaaaaagcgaaagataaattctaccgtcttagccatagtcttgagttttcacagattgcgacaatgttcggcttagaatatctccgtccttatacttgggcggatttgggcacaaaacttaaacaagcctatgctcgtcgaggtgttactattgtggaaatcaaggtgaatgatcaggaaggtagtagcctttataaatccttgattgaacagatctctcgtgcttctatcgactaatgttagcaacaacgtggcacagtcattcaggaacccccgtggtctttctccacggatttcttggttctcaacaagattggcaacctgtcctctcgctcttgcaaaatacgattgcaatccgaccgcttactcttgatcttgctggtcacggtcaaagccaagctatctcgtaccacagttttcaacaagctagagaacagcttcacttcaccttgcaacaacatcttgctgaacagcctttctatcttgtcggctattcattaggcggtagactagctttagattacgccctcacaacccaaaatccttatcttaaagggatcctgctcgaaggggcaaatatcggcttaatcagcgatgaagacaaaaaagcacgttggcaaaatgattgccattgggcagatcgcctaagcaatgaaccgcttgcaaatgttttagaagattggtatcgacagcctgtttttgccaatttaagcgaaagcaagcggacagatttcatcaaaaaaaggctaaataatcacgggcaagcactagctcaaatgctcaaagccactagccttgcaacgcaaccctatttttcccctgaacaacgtcgtcagtttcacggaaaaatgctatttattataggtgagaaagatagtaaatttcgtcaaatggcagaacaacatcagctcccctatcatcaaattgcaaatgcaggacataacacccattgtgaaaatccaagtgcatttgtcaaacatcttattcagtttatatcaaagtaggaattacaatggctttacatcgttgccccgaatgccgtaaaaaaatcagtgaaagtgccgttacttgcccacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttacttgcccacattgtggcttctcgttcaatgaagctgatttggaaatttataaacaaaagctagaacagcgtcgtttgcataatcaagagataaaccgcaaaagcgtcaaacttcacttgatttggttaggtatttttgtgttggttattgggctggcgagtttattatctgtataaatgaatgatgatgtaagtataaaaaaggatagtagataaaactgttgtcccaagaataggcatagtagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctattacacctaaaattatggttatactttataacgtatatttataattcttctgcttgttctaggattttatcttgctcttttattaatttttctaatttctttttttctcggttagcctcatcttctgcttcccatacatcataagcttgaacaatttttgcaacgacagggtggcgaacaatatccttactgtcaaaaaagttaaaacttaactctggaacctcttttaatacttccattgcgtgttttaagccagatttttggctacgcggtaaatccacctgagtaatatcgcccgtaattactgccttagaattaaaaccaatacgagttaaaaacatcttcatctgttcaatggttgtattttggctttcatctaaaataataaaggcatcattcagtgttcgcccacgcatatatgcaagcggtgcgatttcgatcacatttcgctccatcagcttttgtgccttctcgaaacctaacatttcaaacagtgcatcgtaaagtggtcgaagataaggctcgattttttgccctagatcccctggtaaaaaaccgagcttctcaccagcttccactgcgggacgagtgagcaaaatacggcgaatctcttggcgctcaagagactctactgctgcagcaacagctaaaaaggtttttcccgttcctgcaggcccaataccaaagctaatatcgtgacttagaatattacgtaaataggcttgttgatgttcgccacgtggtttaattacgccgcgttttgttttaattgcaatttcatgagccgaacttgtccactgattttgcaacaacattcggctttcttgaatcgctaaatgaacatcttccaaatctagttcttttacttttcctttaattggagcagtttcgttgtaaagttgctgaattaatttcgcacaattttttaataatgttgcagaataatgattttcttcaactgcttgaatagtaaaggtaaatgcattacgcgcaacaataaggttaaaacttttttcaataagggtaagatgctcgtcaaaagaaccgcataacgattgaagacgagcattgtcttgaggctcaagagtgaaaataagttcgttcaaaggatttcctctattttgtactgattctcagcgacttttaaaattcgccatattttaagtgatcttagcacaaaattatagtagaatacctctgttctcatcggggtgctttgtatagcaaggctgagaaatacccatagaacctgatctgactaatatcagcgtagggatttgagacagacaatctatatccgcctgttttagatccttctattttcacttttagaaggaatattcaatgaaattcaatcttttcaccctttctgcgttagccgttgcaaccaccacttttgctcaacagccaacactcacggtttatacctatgattcttttgcttcaaaatgggggcctgctgctaaacttgaagcgctatttgaaaaacaatgccaatgcgatttgaaatttatgccttttgaagatggggtaacaatgttcaatcgtattcgtttggaaaaaaataagactaaagccgatgtaatgttaggtatcgatcatttcttaatgcccgaagctgaaaaatcaggcttatttgtagaacacaatctgcaaaacaatgccaataacttaccgcttgaatggcgaagcaaaatatttttaccctatgattttggagaatatgcttttatctacaacaaagaaaaagtcagtaatccaccaaaaagtttaaaagaacttgttgaacgccaagatcttaaagtgatttatcaagatcctagaactagcaccgttggacgaggattgctcttttgggtaaatcaagtttatggcgaacaggcagaatcagcgtggcagaatttagccaaacataccgtcactgtgggaaaaggctggtctgaaacttatggtgcatttttgaaaaacgaagcagatttggtgttgagttatacaacatctccgctatatcatcaatggcacgaacagacggataaatacgtcgcggcagattttgcagaaggacatttagtgcaggtggaagtagccgcaatcacaaagagcagcagacaactcaaattagctcaacagtttctaagcttcctacaacaaccagaatcgcaacgaattatttcttactataatgtaatgaagcctgttgtgactactaaggcagatcctttatttaacacattgccaacttatcaaactataagtttcactcttcctgataacagtgagataaagcgctggataaatacttggttaaatactgttagccaatagtttttagaatggctaaataagctcaaaggtcacaataacctaccccaactcctgcggatcaatatccaccgtcagtcgaatatcgtttcgcaggaactgttctttttgctcatcaaaacgatctaacaactgttggatcgcacttcttgccgaatgttgaattaataactgccagcgataatgccctgctttttttgccatcggggcgttgaaaggcccaagtaactgaaagccttgccagccgttttcgctgataatttggtgtaaacaagcggtcaaatcttgcagaaaatttgcaactttgtcgctatctctacccgttgcacgaataagcacttgtgaagaaaacggtggtaagctcattatttttcgcatcgctaaggcttggctggcaaaggcaaggtagccgtcgttgagtaagctggtgagtaacgggtgatcggggtaatgcgtttgtaacaccacttctccttgcttttccgcccgtcctgctcgccctgacacttgtacataaagctgtgccaaacgttcttctgcacggtaatcggtggaaaacaggctactatccacattcacgatggcgactaaagtcacattcgggaaatggtgtcctttggctaacatctgtgtgccgatcaaaatttggcttttgcctgcttggatttcggcaaggtgttgttccaacgagcctttacgggcagtgctgtcacggtcaatacgagtaatgctgtattgcggaaaacgctgtgccagcacttgttccagctgttccgtgccgatccctgtggtaatcaaattgactgagccacaatgtccgcactgacgtggaatggctttttgcgaagcacagtgatggcaacgcaatactcgctgtttttggtgataggtaaagggcttatcacaggacgggcaatcggcaatccagccacattcgtggcaaagtaaaacaggggcaaacccccgtcggtttaaaaacaacatcacttgattgcctttttccaagtgagcttgcatcattgctaacaacttttccgataagcccgaataaatccgctgttttttcaaatcaattaaggtttgtttggaaaaatgtgcattaccagcccttgcagtaagctgaagttcgataaatttaccgttttgcacattttgcaaactttcaaaacttggcgttgccgagccgagaataatcggaatgttgttatttttcgctcgaagcaccgccaaatcccgtgcgtgataacgccagccgtcttgctgtttgaacgagccatcgtgttcttcatcaataatgattaagccaagttgctgaaactgggtgaacaaggcggaacgtgtgccgatcacaattgcactttcgccgttttttgctcgaagccacgcattgagccgttgagtgtcgttaagatgcgaatgcaatgcgtcaatttccacgttaaaacgagcttggaaacgttgaatagtttgtggggtcagcccgatttcaggcacaagcaccaacacttgctcgccccgtttcagcacttcttcgatcacttgcagatagacttccgttttccctgagccagtgaccccattgagcaaaaacgctccgaagccttgttgataatgcaaacggctgacgacaagggtctgctgtttattcaacgttaaacggttttgagtgttgcaaatcggctgttcgcctaatttttcctgccagctttgcacgttaaaagggatttccagcttttccagataccctttttcaaacaaagctttccataccgcagggctacaagcggtcggtttttcaaagaaatttgcaaattccgccagtttgcttaatagctcttgttgtttttttgccttttgaaccacgccgttggatagagcttttctgccgttttccgtgacaacaaaatagtcgggagcagtgcgttcactactttccccttgtcgtagtttgacaggcaaagcactttgtagcacttcgccgaaaggggcgtgataataacggcttgcccactgtaaaagttgccacatttcagtgtcaaacagagcttgttcatctaacagttgctcaatcggtttcagtttttcggtgggaatatctgatgtggttgggaaatccaccacaatcccgattttacgctggcgaccaaaaggcacaacaaccctagcccccttcaccacattttcaaaatgcgttggaagcaggtaatcgaaataacgtgccaacggcacaggtagagcaattcggatgaggttcattagggtttcactttgcgaaaactatcaacacttaataagataatggataccgccaaacacgccattaaaatataggatttggcatctaaaacttcaccgatggcaaaggaaataaataacatcaccaaaggttcggcatagccaagcaagcctaatacattaatcggcagtaaattacttgaagcgatatataaaataaatgccattccatttactagccctaataatgctagataaaaatagagatattcattttgcattaaaatagaggcttgatcaacttgagcaatataataaatggcaaagggtaataacaataataattctacaaagaaagtggctaaattattaatatgaaaatagcgacgtaagacaatataaatagggtagccaaaaccggcaacaaaagttgcccacgaaatacttgcggttaaaaagatattaattgtgacaccaatagttgcaaaaaataaagcaagccattttaataaagtaaaatgctctttaaaaaccagtttgcctaaagcaacggcgacaatcggtaataatagataaccgatagaaacttcaatagcttgattattattcggtgcccagagaaataaccaaagctgaatagctgtatttaatgctaagagcagaagaataaaaataagataaggtgtctgttttactctataatataaatctttaaaggctttttgttgatgaaataaaaagatcgccagtaaaataaatggcattaataccacaatacgaaagccaaaaatactatcgctttctaaagggcgaagtaaaaccgcaaaataatagccagcaccaaataagatatttgcagaaagtgaaaataagatcccttttaacattattccccccggcgctgtttacgaatagcaataatgccatcaagcactaatagacatatcgacagcatcaaacacaccattaaaatataggaagattgatctaacacttcgccaataataaaggcaacaattagcattgcaagcggttcaatatagcttaataatcccaaaacattaatcggcacaaggctacttgccattatatagccaattaatgccgtaccactgacaatgcctaataacactaaccaaaaataaaaattcggattattttcggtgacaaattgcatatcggtattgagcataaaataagtggctatcggcaacattaatataatttcgcagacaaagctggataaatgcgacatatcaaaatgtttacgcaaactgaaataaacagggtagccgattaataccattgaggtagcccaagagagtgagcctgcggtcattaacgtaatgaacactccaacagatgcggaaataattgagataatttttaagagagataaggtttcattaaataaaaatcgcccaacggcaaccattgcaatcggcattaacagataaccaatagacacatcaatggcataaccgttgtttggggcatacagaaaaagccacatctgcgagcctgtgaccgcagtagttgttaataataccaaaattaaatgggggtgctgttttaggcgttttaaatagcggttaaattcgtcgttttttttgaaaataaagagtgcagaaatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaaagacgaagtgcgatttatgttcacggacggacgccaagcgtggcgtccctacaatgttacataatagatttttggacgcacacagtgtgtcccatatattttaaatggaaatgcttaattaatcttgacgataactctgtaagaatttcgctaatcgaccaatagcttcttccagttgatccacatacggcaatgtcaccacacggaagtggtctggtttatgccagttaaagcctgagccttgaaccagcaacactttttcctgttgaagcagatcgtaaacaaatttttgatcgtctttgataccgtacatttccgtatcaattttcgggaacatatacatcgccccttttggcttcacacagctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttttggcttcacacagctaatcccagggattttggtgagcaattcgtgagccttattacgttgttccaataaacgaccacccggtaagataaattcgttaatgctttgataaccgcctaacgctgtttgaatagcgtgttgcatcggggtgttggcacataaacgcattgacgcaagcatatctaagccttcaataaagccttttgcctgatttttcgggccgtttaacaccatccaaccttgacggaaacctgccacacggtatgcctttgacaaaccattataagtcaccgttaaaagatcaggggcaagaggggcaagatgatgatgtaccgcaccgtcatagacaattttctcgtaaatttcgtctgagaaataataataactgacggctatacactgctcccgttgggttattcgggttaatcaccaaaattgctttggttcttggggtgattttcgatttaatatcttcaatatctggaaaccactcattttcttcatcgcaaaggtaatgaaccgctttaccgcctgcaagggttgccgccgctgtccaaagtggataatctggcatcggaattaaaatctcatcgccatcatttaacaaggcttgcattgacattgtgatgagttcagatacgccgttaccaatgtaaacatcaccgacatctaaatcacgcataccttttaattgataatattgcacaatcgccttacgagcagagtacaaacccttagagtcgcaatagccttgagcggttggtaagttacgaataacatcaactaaaatttccgcaggggcttcaaaaccgaatggggctgggttaccaatgtttaattttaaaatcttatgtccttcttcttccagacgggtcgcttccttatgtataggcccacgaatatcgtagcggacgtgagctaatttatcggtttttgcaaaacgttccattgtttctccctaaaatagagggttaattatctgttaatttataaaaatcactctactgtactccgatttgttaggaaaaaaaagtggaaataggctaaaatagacttctttttgtcaagcggtgagatttttaggattttttgcaatgtctgtgtttagtcagttaaagcaacaactttatcaacaactacaacaaaagcctgtggcacaaggcttagtacagttgcaagcagaaattgcaatagaccttgaaaatcaacaattactagcttggctaaaagcacaaccgcttttcccccactactactggcaaaatcgagatacagaacaaacgatagtggcagtcggtgcggtacaaacctttgagcatttagacgatgtagaacaatttagcaaacagtctgatttaatggtcgtcggcggaatagaatttgaaggacaatgccattttgtgttgccacgcttactgttagtaaaaaatgagaagaaaatcaccgcttggttaaatctagatggtcgccattttgaaagcgaacaaaaggaatgtatcgctttgttagctcagtttgagcagacagccgaacttcaccccattgaaaatagcttgttaagcacaaaagttgcctgtgatttttcacgttggcaacacaacattgaattagcgatagaacaaattcaacaacagcaaatgaataaagtggtgttagccaatgcgaccatcaaaacttttacacaccacatttccccttacgttctgctttttgccagccaacaaaaaaatctaggctgttatcatttcttatggtcggaaaaacaaggggaagcctttatcggctcgacacccgaacggctctacttacgccagcaacgtcaattttttaccgaagcccttgcaggcacagtggcggtgacggacgatcctgttcaaacggaacaaaatgccctatggctactcaacgatcaaaaaaatatctatgaaaattggctggtcgtggacgatatttgtagtcatctggcggattgtgcaacggatattcaagtcagcgatgcagagatcaagcggttacataacgtgcagcatttacgccgaaaaatccaaacgcaactgacagagcaggtcagcgacgcagattgccttgctcgtattcacccaaccgccgccgtcgcaggactgccacgccctaaggcaaagcagtttattcaacaacaggaatgttttgagcggggctggtatgcaggggcattaggctatttcacccccgaacaagccgagttttgcgtaatgttacgttcagcccttattcaagctaatcaaattaccttttatgcaggggcaggaattgtcgaaaaatctgatcctcaatcagaatggcaagaaattgaccgcaaagcacgagcaatggcagggttaatggagtaatttctttttcatattttacttctgcgccttagattttcttcacaatagtcataatgtggtagtcgaaattagaataaacagactaggatatatctgttgagcttaattagaagtcagcaataagaaaccaggtgctaattattcattatattacagaaacattctatttattttacaggtataacagactaggatatatctgttgagcttaattagaagtcagcaataagaaaccattgggggtagcacataacaatcagtaggggtggtgggactctaccttttagtaagcaggtgctaattattcattatattacagaaacattctatttattttacaggtatatcacgtagttttttaatgaatacaatttaatgttgcataggatttataatatggtaaagaaactttcatttttgacgttattaatgttgttcattccagctacagcgtggttaattgggtggcaatggaatttgcaaactaatcttggtgttaatgttttcgattgggcgttatttattttaacggaaacgggttcaacgccttatgcgttaatcacttgcgtgctgtttatgttgtggctgatgtggcttgcgcgcactcgctattcgtggtttttagtaggctttatttgtgcaacgtcggtagttggaacacaggcaattaaagagggggcgaaagcggtctttaaagagcctcgtccttttgtgacacagatgtttcaggcggatactgaggcattttatgctttacctaaagctgaacaggaaacggcggtattgaaatttgtgcaacctgaaaatcagtttgtggttgaacatcaagcagatgagctgggctactctttcccgtcagggcatacgatttttggggtatcttggctattgatgtttgcagggttgctgtttggtattcgtggacaagcggtgatttttgctcaattttttgtgattttgtgggctgatttgatgttgatcagccgtttgcggttaggaatgcattatcctatcgatctgtttgtcagtactttgattgcgtgggttttccacttgatcatcttcttatgggtaatcccactcttagaaaaatggacattatttaaaaagcgaggctaactatggtttattacggtttggatattggcggtacaaaaattgaattggctgcctttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgcctttaatgagaaattagagaagttacacagcgagcgagtgccaaccccacaaacgagttatgaggattggttaagaacagtggaaaccttagtgcgtaatgccgatgcaaaatttggcgagcacggcactgtggggcttggtgtaccaggttttgttaatcataaaactgggttagcggaaattgccaacattgcggtggttcacggcaataaaattattcaagatttggaagcacgtttagggcgtgaagtgcgtgttgaaaacgatgcaaactgcttggctttatcggaagcgtgggacgaaagcaatctgcaatattcaacggtgttagggttgattattggtacaggttttggtggcggtattgtgttgaacggtaaagctcactcaggtcaaatcggtatagctggcgaagtggggcatattcagcttaactatcacgcgttgaaattgcttggttgggataaggcaccgatttataaatgtggctgtggtaatatggcttgtttggatagctatatctcaggacgtggttttgagatgctttataatgatttagtcggcgaaaaagttgatgcaaaaaacattattcagcgtttttacgataaagatgagaaaaccgttgagtttgttgagaaatacattgagttaatggcaatttcggtggcaaattatattacggtacttgatccagatatgattgtgtttggtggtggtttgtctaactttgattatatttatgaagtcttgccaaaagccttaccaaaatatttattgcgtaatacggaagtgccagtgattaaaaaagcgatccacggtgactcaagcggtgtgcgtggggcggcagcgttattcttgaaatagtaggtcgggcatttatgcccgacaatcatttataaaataccgcaaagttaggcatttatacccgacaatttttcataaaatatggcaaagcaggcatttatgcccgacaatttttcataaaacacggcaatgtcgggcataaatgcccgacctacggaaaataaatatgcttcaaatcaccccaattccagccctttctgataattacatttggattttacaaaaagagtgccaagcgattattgtcgatccagcagaggctcaagctgtattcgcttttcttgcaaaacatcagcttaatcccaccgctattttgcttacccataatcatcacgatcatactgatggcgtggctggtttagtggcacaatttcccgatatgcttatttatggctcagaagaagtgagccaatttgccaatcagattgtttaccctgagcaacagtttgaactgttagggttaaaggtgcgagtgattgagagtgcagggcatacggcgcaacatattagctatttggttgataatgaatatctcttttgtggtgatgcgttattttcaggcggttgtgggagagtgtttacaggggattaccaagctcagtttgatgccctacaacgttttaaagccttgcctgattttgtgaaagtctatgctggtcacgaatatactcaaagcaatttgaaatttgccgaagcggtaatggcaacaagctgtagtttaatggaacatcaagagcgagcggatattttgcgttcacaacataaaccaacgctaccgagtacgattggtgttgaaaaacagattaatccatttatgcaagcggtgactttagatgaatttattatattaaggcagaaaaaagataatttttaatacatataagctaaatcctatctagcacatcattcttaatttcccctatctctcatcatatgatatagttaaaaacgttttcatgtttattgttcaaataggtaagttgctgtgaatatagatcttcaaaatatgcctcagcatgtggcgattattatggatggtaatggacgttgggctaagcaacgagggaaattacgagtatttggtcacagaaaaggggtaaaagctgttcattcagctgttaattttgccttaacgcaaggaattaaggtattaacgctatacgcatttagcagtgagaattggtctagaccgaagttggaagttgccgcattaatgacactatttatagaaacattggatttaaatataaaaaaactacacagcaataatattcgcttaaaaattattggtgataaaactgcttttagtgaagcactgcaagaaaaaattgaactggctgaacaactgacaaataaaaacactgcattgactttaaacattgctgcaaactatggcggacaatgggatatagtccaagcaaccaaacgtattgcacatcaagtaaaaaataatgtcatacctatcgaagatattacaactgattaccagcacgatttattaattcgtactagtggagaacagcgaattagcaattttttattatggcaaattgcttatgccgagttagtatttagtccggttttatggccagattttgatgaaaaggcatttacagatgccgttattgcttatcaacaacgtgatcgccgttttggtggttgttaatctataaggaaaattcaatgcttaaagaacgcattctttcggcaatcgtgatgattattttagcagtggttgcattgttttggctttcacccttagcttttacgattggcttatccgctattgttgtgttaggtatgtgggaatgggctcagtttgcgggttttaaacgtccgatagcacgtgctattgttgcttttgtggtgacctgtttattgatttttcctattatggcagaaacaagttatattcaagctacacgttttttaacagatgaaacaataccactattatttgtaggttgtttttggtggttcatcgcatttggattggttattacttatcctaattcagcttcaatttggagtaagtcagtagcagccaaatttatttttggtttttgtacactcgtcccatttttaatcggtactttagcgttacgtttttatcaatataatcttgaacaatatcagggaacttatttacttctctatgtgtttttattggtctggggagcggactcaggcgcctattttgtaggtcgtgcattcggtaaacataaacttgcacctaaagtgtcaccaagtaaatcttgggaaggggctattggtggtgtgataacttctgctgttattgcaacgattttcttaagtgtagtgcctgcaaatgtgtttgggcgtgagttaaatacttctgcatttgttgtactttcagttattacggtagcgatttcgattttaggcgacttgagcgaaagtatgtttaaacgccaagtaggcattaaagatagcagtaatttaattccaggtcacggcggtattttggatcgtattgatagtttaacggccgccgtgcctatttttgctatcggctttttctttttcctatagggtagcgcaatgacttcaatgctcgccttttttattctgatctgcgtgttggtattcgtacacgaatacgggcatttttgggcagcgcgaaaatgtggcgtaaaggttctacgtttttctattggttttggaaaagtattatggcgtaagaaagataaacaagggactgaatttgcattttcactcattcctttaggtggctatgtgcaaatgcacaatggtgaagcagaacatcaattaccagattcgcaatctttacatacaaagtctgttttgcaacgtgcttttatcgttcttgcaggtccagtggcgaattttttatttgcgattttggcgtattgggcggtgtttaatgttggggttccaacggttaagccagtgatcggatctgtgattccagattctattgcagcttatgcaaagctggaaacagaattggaaattaaaacggtagataaccgttccgttcaagattgggaagatgttaccctagctttgttgggcaagattggagaagctgaagttgttattgaaggcaaccatattgatgaaaatatttctcgtcaatttacgctagatttgagaaattggaatgttgatggaaataaggaaaatccgttaactactttaggtattcgtcctaaaagtgcgacggttgaaccaattattaaaaatgtagtcgaaaattcggtttcggcaagatcagggattttagctggcgataaaattatttctgttaatcagcaaccttttgaatggcgatatttgttagagcaggtgcaaacaggtaatattattgatttgacgattgaacggaataaccagcaattagcttttcagttgcagcctgaatattcaaaggaagatgagcgttatttaataggcttagtgccaacgtatcaaccattagaatcaaagtatcgaagtgaattaaagtatgatattctttccgcctttggaaagagcttagaaaaagtcgtatcattaagttatacgattttacagtttattggaaatttaattacaggcgagctttctctaagtaatatgggcggcccaatttcaatggcaaaaggggctggggcaacggctgaaattggttttgtctattacttaggatttatggcattgataagtgttaaccttgcagtgatgaatctgttccctattttgcctttagatggtgggcaattagttttactcactggggaagcggttcgtagaaaacctgtacctgaggcattccaactgcgttttcagcagattgggggtatgtttgtcgtagggttaatgctatttgcattgtttaatgatttaatccacttttagtcaagtggttagatatttatattattttaccaacgaataggatcatttaaatgaaaaaactattactttcaacattattagttgcaaatggcgttgcttttgcttcaccttttgtgatcaaagatattcgtattgatggtatccaaacatctgtaagccaaacaatgatccctacattacctgtaaaagtaggacaactagcgactgataatgatattgcaaacgttattcgtcatttatttgtacaaaatcgttttcaaaatattagtgcaacccgtgaaggagatattttaattattaaagtggtagagaatccagtcatcaataatgttgatattgaaggtaattctgcaatccccaaggagccactggaacaaaatctaaaagcgaatctcatcactaaaggagaattatttaattctacaaagttagacgcatttaaatcagcacttattgagcattaccactctataggtcgttacaatgctaccattgatactgttataacaaactcagacaatggaggtgtaaatattaaattagatataaaagagggagatgttgcctatgtaaaagctattaattttgaaggaaatcaagcttttacatcaaaagtattaatgaaacaactggatattcaacctgatgtttcttggttcaatatttttcaaagtagtaaatttgaacaaacagcatacaatcaagatttagaaaatctacgtaatttctacatgaaccaaggatatgcaaaatttaatgttgaagctgaacaacccgtatttagtgatgataaaaaagaagtatctttaacatataaaatcaatgaaggaataccttatactgtaagtgaaatacgtattattggtaatactgcaaaattagataacgagttaaatgaacagctcaaatattataaaacaggcgagctctttagcaaaaatgaactttcaaaaattgaagacaatattaaacaagtatttggaaataatggttttgcttccgctaaaatagagcttcatccaaccttcgatgatacaaataaaacaattcgtctcacatttgttgtggatgctggacaacgtgtttatgtaagacagattcgttttgaaggaaatgatgtgactgcagattcaacgttacgtcgagaaatgcgtcagcaagaaggagcatggttgtcaacaagtctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaagaacgcaatacaggaagtattaatttcggtgttggttatggaacagaaagtggtttaagttatcaagctgggataaaacaggataatttcttaggtatgggctctacaattagtttaaatggtacccgtaatgactatggtacaagtatcaatttagggtatactgaaccatactttactaaggatggagtaagccttggtggaaatatcttctacgaggattatgataattcaaaaaataatagtgtcgcaagttataaacgacaaacctatggagtcaatagtactttaggattccctgtaaatgaatacaactcctatttccttggtctaggctacactcaagatctgattaagaatgctcgacgtgaatttaatcgtgaactttatgtacaatccatgaaattcccgattgataatgacttaaatgtctataaaaaaattaaagcaaatgacttcgatttttcttttggttggaactataatagtctaaatcgaggttttctcccaacagaagggactttgacaagcattagtggacgtattaccacaccaggttcagacaataagtattataaagttagtattgattttaaaaactatttaccagtcaatcgcgaacataagtgggttatctcaactaaagcgaatattgcttatgcaaatggttttagtggtaaagaattaccattctatcaaacttatactgcaggaggtatcggctctctgagaggttttgcttatggagctattggaccaaaagcaatctatctgggtaaagataacaatggtaatatccgattcaattctgtaaatggagatattgttggcggtaatgcaatggcatctgcaactttagaattaattactccaacaccatttgtaagtgaaaaatatcaacataatgtaagaacttcattatttgtggacgctgcaacagtgttgaatacaaaatggaaaactaatccagtagtaaacgacattcaatataattattctagtttagaaaactttaaagattataaacgttttcgtgcatctacaggtatcgcattccaatggaattccccgataggtccattggtattttcttatgcgaaaccaattaaaaaatatcaaggtgatgaaattgaacagttccaatttagcattggtggttcattctaatcttataaacaagcggatagatttgttcatttttttacgagtctatctttcctaacttcagaaaggacattttaatgaaaaatttatttaaacttgccgcagttgcttcagctttagcttttagtgcgaatacagtaaatgcaaatgaaaaaattggatttgttgatcctaatttcttgatacaaaatcatccacttaccattgaagcaaatgataaattcactaaatttatgaaagacactgaatctaaatttgcaccaagggaaaaacaattagcagcagaaaataaagcattatctgatgaagaaaaagcattattggatgagcgtaaaaaaattgaagaagatgcacagaagttacaaaaagaacaagtgaccttagaagctgcaatgaagaaaaaggtagcccaacttgaaaaagatgcacctaggttaaaagcgaaagagatccaagcacgtcaggataaaattaacgcagaagctaaaccattccaaaataaagtttctgcattgcaacaacgtgaagtagaatttggaaaaaaagcagaagagttccaaaaacgtgctgatgagtttcaaaagaaagtagcggctttccaagaagaaattgctaaggtacaaaaagaatctggtgtaataactcctgaacaagtacaacaaaaagtcgttgaagatattaatgcgaaaattaaacaagtcgcggaatctaaaggctatactttagttcttcctccatcggtcgcattatatgctaaagatggaaatgcagcagatattacagaagaaattctagttgcaatgggtggaaaaatgccagaggctccaaaaactgaagtgcctgcagcggaagtcacaaaaccagaagaagtgaaaaaataatggctgaattccgtttaattgaattagcggagcagatcggcggtactctaaagggtaacgccgatttggctattttaagcattgctcctttagataaagcaacttctaatcaaattacctttatctctaatgcaaaatatcgtccacagttatcgcaatgccaagcgggagctattattgtttctgaagctgatgtcgaattttgtgccgaaggtcaaaacttgatcgtggttggaaacccttatgttgcttatgcgattttagctcaatatatggatacaaccccaaaccctgccgaaaatatcgctgaaagtgccgtgatctcacctgatgctaaattgggtcataacgtttctgtcggtgcaaatgctgtgattgaaagtggtgttgaaatcggtgatgatgcggtgattggtgctggctgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcggaaaaaacagtaaaattggtgcaagaaccaaattatgggcaaatgtgtcggtttaccataatgtacaaatcggctcagattgtttaattcaatcttctgccgttattggtagtgacggttttggctatgcaaatgagaaaggtcaatggattaaaattcctcagactggtggcgtgattatcggtaatcgtgttgaaattggggcttgtacctgtattgatcgtggtgctttagatccaacggtgattgaagacaatgtgattattgataacctatgtcaaattgcacataacgtacatatcggttatggcactgcgattgctggaggtgtcgtaatggctggtagcctgaaagtaggacgcttctgccaaattggtggggcaagtgtaatcaatgggcatatggaaatttgtgatggggcaatcattactggaatgggaatggtaatgcgaccaatcacagagaaaggaatttactcatcgggtattcctttgcaaactaataaagaatggcgtaaaacagctgctcttgtaatgaatattgatgaaatgaataaacgtttgaaagcattggaaaaacgtttagctgaataattgattgaggtcttagtagtgacaaccaaattacaaacagaaaatcgtgaaccaagaattattgaagtaactgaaattatggaaatgcttccacatcgttatccattcctattagttgatcgtgtggttgattttgaagaaggtaaatggctccgagctgtaaaaaatgtgagtgtaaatgagccttgttttactgggcattttccaaatcaacccgttttcccaggtgtacttattttagaagcaatggctcaggcaacaggggttttagcaattaaaagctacggcaaattgaaagacaatgaactttactattttgcagcagtagataatgctcgctttaaacgccctgtagtaccaggcgatcaaatgatcattgaagtgacctttgttaaagagcgtcgaggtattacggcatttacaggtaaagtttatgtagatgatacgctagtttgcgaagcagacctaatgtgtgcacgtaaataatcttgcttgaataaagaggaaaatactatgccattaattgacgcttcagccaaaattcacccaacagccttgatcgaagaaggtgctaaaattggtgcaaatgtagaaatcggtgcattttgtgttatcggcaaagatgttcgcattggggctggtacaaaaattcactctcacgttgttattcaaggtgatacagaaattggtgaagataatcaaattttccaatttgcaagtattggtgaaattaaccaagatcttaaatatcaaggtgaaccaactaaaaccattattggacatcgtaaccgtatccgtgaaagtgtgactattcatcgtggtacggttcaaggcggtggtgttacgcgtgtaggtaacgataacttatttatgattaactgccatatcgcccacgattgctctatcggtaatcgttgtattattgcgaataatggtactttagccggacacgttacccttgatgattttgtgattgttggaggaatgtcagctattcatcaatttgtcgttgtgggatcgcacgttatgttaggtggtggttcaatggtgagccaagacgttccgccttatgtaatggctcaaggcaaccacgcccaaccgttcggtgttaatcttgagggattaaagcgtcgtggctttgagaaagcaacaatgcacgcaatccgtaatgtgtataagttaatttaccgcagtggtaaaaccttagaagaagctattccagaaattgaacagtatgccaaaacagaggcagcggtcagtttattcttggatttctttaagcgttctagacgaggaattattcgttaatttgttcatgctctcttattgaggaattaaaatattcgagcatacattctgtatcaatggcaaaaatgtatccatataagatgttgttctaaagaatatagatacatcgatttttaatctgacatattaatagtagttattctataaaaacctgttgacaaacgctctattttagaggattctctcattcactttttacgcttaatatttagagaatagcgatgaaccgtttttctatgattattaccacgatgatgaccattatgtgccaacatagtgcgggtgttcgtggctagaaaacggaacaagattcacagaaacccgcttaaacaagcgggtttttttgtaacaaaatttgcaaacattaactattatcttcaggagaaattatgcgagttctaaaatttggaggcacttctttagccaatccagaacgctttttacaagccgctgacatcatcgaaaaggcacatttggcagaccaagccgcaggcgtactatccgccccagctaaaatcactaaccatcttgtcgctattgtcgataaagcccaaacaggcgaatcctacgaatctcatctcaccgaagccaccgacattttcaataacatcatcaacggattatatgccgtcaataacaatttcgaccgtgaaggattaagtgcctttatcaaagcagaactagacgacatctgcaatattgcagctgaagcagcaaaaaataaattctgcccagataatatcggtgcaacagtgcatagccgtggggaaaaattgtcgattgcgatgatgaaagcgtggtttgaagcgaaaggttatgaagttactcgcattgatcctatcgaaaaattattagcacacgggagctatttagaatcttctgtggatattgctgaatcgaccaaacgtattgaagctctttctattccaaagaaaaacgtcgtgttaatggcgggctttacggcaggtaacgaacaaggtgaattggtgttacttggtcgtaatggttcagactactctgctgcctgtttagccgcttgcttaaaagcggatgtgtgcgaaatttggacggatgtggatggtgtttatacttgcgatcctcgtttagtaccagatgcgatctgtttagagtctatgagctatcaagaagcgatggagctttcttacttcggtgcgaaagtgatccaccctcgcactattggtccgttagtaccgttaaacattccatgcttaattaaaaatacccataatccagaagcaccaggcacaatcattgacagtaatgtagtcaatgataatttaaaagtgaaagggatcacgaaccttgataatgtggcaatgttcaatgtttcaggctcaggtatgcaaggtatggttggtatggctgctcgtgtgtttacttcgatgtcgcaagcgggtatttccgtgaacttaattacacaatcttcttctgaatatagtattagtttctgtgtgcctgtaaaagcggtcgaaaaagcactctgtgcgttaaacaatacttttgctcaagagttaaaagatggctcgcttgatcctgtggaagtgatcaaagatctctcaattatttctgtggttggtgacggtatgcgtaccgccaaagggattgcggctcgcttcttctctgcactggctcaagcaaatatcagcattgtggcgattgcacaaggttcatcagaacgttccatttctgctgttgtgccgttaaataaagcgattgaagcggttaaagctacacataaagcgttattcaataacaaaaaagtggtcgatgtctttttagtgggggttggcggtgtgggtggcgaattgatcgaacagatcacaacccagaaggaatatcttgcaaagaaggatattgagatccgtgtttgtgcattagctaactcaaataaaatgttgctcaacgaaaacggcttaagccttgataactggcgtgcggatttagagtcggcgacacagccatctgactttgatgtgttgctttcattcattaaattacatcacgttgttaatcctgtttttgtcgattgcacgacagcacaatcggtggcaaatctttattctcgtgcattaaaagaaggcttccacgtaattacaccaaataagaaagcgaatacctcaagctatgcttattatcaggaaatgcgtgaaaatgctcgtcaaagccaacataaattcttatatgaaaccaatgtgggcgcaggcttgcctgtaatcgaaaacctacaaaatttgcttgctgccggcgatgaagtcgagaaatttgaagggattttatctggttcgctttcttttattttcggtaaattagaagaaggttcaagtttgtctgaagcaaccaccattgctaaagaaaaaggcttcacagaacctgatccacgtgatgatttatcagggcaagatgtggctcgtaaattgctgattttagcccgtgaatgtggctatccattagagctggaagatattgaagtggaaggtgttttaccaaaaggtttctctgaaggcaaaactgcagcagaatttttagcgatgttgccggagattgatgtggaatttgcaaaacgtgtggaaaacgcgaccgcttgtggcaatgtgttgcgttatgtgggctccattgaaaacggtaaatgccgtgtcgcaatcaaagaagtaaacggtgatgatccactttataaagtgaaaaatggtgaaaatgcccttgcgttctatacccgttattacagcccgatcccactgttactgcgtggctacggtgcgggtaatgatgtgacggcagcgggtatttttgcggatattttgcgtacactgaattaaatctacatttgcaaaattttgttccaaactaaccgcttataacggatgccaagcgtggcgtccccacaaaaatggttataaaaacaaaggaaaaaaatgacattacgaatttatgctccagcttcaagtgcaaatttaagtgtcgggtttgactctcttggcacagccatttcgccgattgatggctcattactcggcgatgtagtacaaattgaagagtgtgatcaaccgtttgagttggaaagtgtcggttattttgtgcgtaaactgccgaaagaaccgcaaaaaaatatcgtctatcaagcctatgtgctgtttagcgaacgtttgaaattgcgtggtggcgtagtgaaaaatttacgcctcacccttgagaaaaatatgccgattggctcaggcttaggctcaagtgcttgctcaattgtggctgctctcgtagcactgaataaattccacgatgaaccgttttcaaaaatggaattgttggaaatgatgggcgaactagaaggtagaatttctggctcaatccattacgacaacgttgcaccttgctatttaggcggtttgcaactgatgactcaatctctcggcaatatctgccagccgattccgttttttgacgaatggtattgggtgctggcttatcctgggattgaagtttccaccgcagaagcccgtgcgatcttgccgaaaagctatacacgccaagagatgatctcacaagctcgctatttaggctctttcgttcacgcttgtcacactcgtcaagatgtacttgccgcaattatgatgaaagatcttattgctgagccgtatcgtgaatcattactgccaaactttgccgaagtccgccaaggttgtaaagatttgggggcgttagcggtgggtatttcggggtcaggcccaactatgttcgccattgcaccagatttagaacacgctcaaaaactggtcgattatcttgaaaaagattatctacaaaataatgagggttttatccatatttgtaaggtggataatttaggagcgagagagttgaagtaagctcggcatacataattattctcatagactccgcccttattaagggcggaaaagcaagagaaaatataaaatgtcttagtaaagtaaattcctaccccctcaaatcattcgcctgttgcaataaattacggctctctttaaggaactgttcggaataatcgccaaaccaacaatgcactttttcaaaggcatcaataaagccctgtttatcgttttgctgaaagaatgccaagctcttttcaaaactctgttgtagcgaggcaatgacatctaaattttcaggcttatcggcaataatttccgcatacaatttcgcatcttgggcaaatagacgaccgatcatcgccagctctaaacgataaatcggtgacgaaagtgcaagtaattgtggtaatttgaccgcttgttgcgataaatgtaagccataagcaaaggtggaaaagtggcgtagtgcttgaatgtaggtcattgcgtgatcgtgttctgtggcatcgatctcttcaatcttcgctccccaaatccgcatttggtcaagcaaccattgataacgttcggcaaaacgcccgtgacaacaagcgatcacttgtttggcaaaacttgcaatatcaggcccaaacattggatgaagcccgacgacggctccggaatgcacttctaacatcttcgctaacggctgtgctttgactgaggtgagatcagctaagatcatctgttcgttcaaatacggctgtaaacgctcaagggtgtctaaggtgttggctatcggcacacaaaccaccactaaatccgctccgtgcataatctgttcggcttgctcccagtcatctcgatcaaggcgttcgaccgagtagcccgataattcaaaatagcgggcaaacagtccgcctaacttgcccaagccaccaacaaccacgattttccgcatttgctcatttgtcgctttaaagccgtgtttattctcgttggcataagattcccgcattagacgacgcaacacatcttcaatcaaatcagcaggaatgccctgactttctgcttcttgacggcgagcggcaatcattgaggcttcacgttcagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcataaatcggcaaaccgtgctggtgcttaattttgccaacttctgccaccagtgaaagacgttttgacaataattcaattaactgttgatcgacttgatcgatctgttcacgaataggatttaatgggttcatactactttcttagggtctctgcaaaatcggttaataaggtttccgttgtctgccaatcaatacaagcatctgtaatagatacgccatatttcatctgttcaaaaggttgctcggatgattgattgcctgcaaacaggtggctttcgatcattaagccgataatagattgattgcctgcgacaatctgttgtagcacattttccgccaccaacggctgacggcggtaatctttattagagttgccgtggctacagtcgatcataatcgcttcaggcaagccggctttgcgtaatgcttgctcgcactcttgcacatattgtgcttcaaaattcggggattttccaccacgtaaaataacgtgtccatcaggattgcctttggtttgcaataccgtcacttgcccctgttggttaatgccaataaaactatgccccattgcagaagcctgcattgcattaatcgccacgcccaaatttccgtccgtgccgtttttaaatcccaccgccattgataagccagatgccatttctctgtgggtttgagattccgttgttcttgctccaatcgctgaccaactaaacagatcagcaagatattgtgggctaatcggatctaaggcttcggttgcaagtggcaagcccagttcagctaaatccaacaataatttacgtgcaatgcgtaaccctttttcaacatcgaaggtgccgtttaaatgtgggtcattaattaagcctttccaacccaccgtagttcgtggtttttcaaagtacactcgcattacaatgtaaagtttatctgacactttgtcagctaacacttttaattttttggcatattctaatgcagatacaggatcgtgaatggaacaagggccgataacaataagctggcgtttatcacgtttatgaataatatctgagatcacttttcttgattcttcaatctgtttacgcagatgctccggcaacggaaactcttgttttaatccctttggcgttagcaaaactttttcattacaaatgtttacgttgtgtaaactatcctgattaaatacagtgttcatttttatttcctataattgtaaaaaaatcaatacagaggtaatttacaacgtaattggcaaagtttcaatggttttttgagtttaatctatcaagctgtcaaagccctataatatttcgggcggacacatcggtccgcccaaacaatgattttataaataatcttgaattttctgtttcacctgctctactgaaattctctccatcagtccatcacctttcgcacttgtcgcccaaggcaactgatcccaaggttttccacgactttctaatacaacctgatcataaacagacaccactttatctaaatctaaataagggcctgtacggcgtgggttatgaatcgcatatagaccaatcaccttcgtattttgagttgtcgcaatatgagctggccccgaatccgaagatagcaccaaatccgcttgacgaattaatgcggcaagttgttttaaattggtttttcctgcaagattaaggctgttcagtgcaagttgttgaatttttgctgctacttccatctcataaaccgatggagagcctgcaataatcacattgatgttttgtgctaatgcaaactgtgcaatttgcccataattttcaggcgaccaatctttctcttttttgctagaacaaggggcaatgactaaattttttctttgtttatcaataaattgcgacgtataggctaaatctgcttcacttacaggtaaatcccaagttgggcgtagatcttgcacaccaatcgctttagcaaacatcatttgaccgtctaaaacgtggggggaagcggtctgttccacctttttatttgtaaatagccactgtccttctcttgcccgatcttgattaaaacctactttctgttttgctcgaatacctaacgataaaatagatgcacgcaatgccgtttgcatatttaacagataatcaaaccgcttactgcgaagctgtttccataacgccaaaatccctttccatcccgtttttttatcataaggcacaagggttacattcggaatgccttgcattaacatcgactctgttttaccaataatccaagtgatttcagcttgcggatattggcgttgaatggcttgcacgacagcaagggtatggcaaacatcaccaatcgcagaaaggcgtaaaatacagattgattgtgggctgttcatcttcattcctataaacatttcgcaggttttggcaagcctgcaattttggttgcctgttttgctgggccttcggggaataaacgttgtaaataacggctactgcctttttcttcaccaaatttctgtgacaaggcttttaccagcattcggattgcaggggatgttttgtattcttgataaaattctcgcacaaaatagacgatttcccaatgggcttcgctaagttcaaggttatctttttgagcgataactacggcaagttcaggcgaccagtcgtctaaatttttcaaatagccgtgttcgtctgtggggtattgttgatgattgagttcgataaaatgaagcatacaagatggggtgtaggatgaaaactctaaaaaaagagcccagtattctaaaaagaacttaattaaaatgcttggctataaatatattacttcgtcaaatcaatctgataaatcgcaaagcctgtttcatcagtgccaacgaatgacattggatattgtgctttttctacaataaaggctttcgctttatcgcttggcgacgtttcaaaataaggctcatcagatgggccagtgtgagcaagtgctacgattaaatccgcccccgcttttttcacgattggcacatatttttcagccgttttcacaatatcacgagcttccactttgccgtctaaatgggctttatcccaaaccattacttgtggtggaacgaaaccgatataaccgacatttaaagtatgtttcacgccatcttcatcaaccacttcttttttctgaatgaagtatggttggtaaactggctcatcagtacctggtttaacgcatcaatcgcagggttagatttaccctctttataaccgaccgcagcttgataatccgcaatcggattaccttgaattaagtcaccattatcaacaagtacactattttaagcttcttttcgagcttgttcaattaacgttgcggcacgagtaaaaccaaattttgttgttggcgcatctttataatagtcaaaatccgttaaaaaactgtgaatatccgttgtgccaatgacacgtaagaaactttgctatcaccagctgcaaatgcaaagcgatttgcactaatggctaatacagtggtcgcaccaatttgaagaaaacgtcctctgttcatcataacaagtatcctcattgatataaaaaaagggagagtattataggcaataatactctaaaatgccttaatccttttatcaaatctgtgatcgacttcacagaatagataaattaaggctgtataaaaaccgctattctaatttctgaagcggttactttagagggaatatagaacagataaaaactagattatctatgtaattagaaataaataatacatataaatctacttaagatccctatacctcataaaaatccctgcatgataagcagggatcttattagattaaacttttaataggttactcttttgacttccaaattaacggatcaacaccacggcgaataagctctgggtgatcttcaattttgaatacaggctgctctacccctgctttcacttgtttttggtaatcttttaagataacccaaacaattggagcaagtaaaacgatagacactaagttgatcatcgccattgatgccattacggtatcggcaaacgcccaaacaataccgccatcacgcacagcaccgaagtaaacgaaaaataacacgattaaacggaaggctaatacgaaacttggtttgttacggatatagcgaatattgctttctgcataagcatagttaccgataattgaagtgtagcagaataacaataagataaaggctaagaagtgtaagccaaattcaccgatgtggaactctaacgctttttgggttaaagatacgccacgcaatgattcgctaccataatcgttagacattaaaataatgattgcggtacaagtacatacaataatggtatccacaaatacccctaacatttgaattaagccttgacttgcagggtgttttgcatctgacgttgccgctgagtttggtgcagaacccatacccgcttcgtttgagaataaaccacgtttaatccccattaacatcgcttgtgagaataatgaaccaaagataccgccagccattgcagaaaagtcaaaggcactggtaataattttatttaaaacttcaggtactcgctcaatattcatccctaaaatgatcattgccataattaagtagaataacgccatcatcggcacaactttcgctgaaacctgaccgatacgtttaatcccaccgaagataatcgctgcagtcacaatcactaacacaatgcccacataatgcggatcccattcccacgcattacgcgttgcttcaacgatagagtttgcttgaaccgcattgaacgcaaaaccgaaggtaaaaattaaggtaattgcaaaggcaatcgcaagccaaggagcttttaaaccacgcttaatgtaataagctgggccaccacggaacataccgtttggatcacgcactttataaacctgtgccaatgatgattctgcaaatgcactactcatacctattaacgccgtgatccacatccagaacactgcacctggtccgcctaatgcgatagcagtcgcaactccaccgatattacccacgcccacacggcttgccaagcctgttgcaaaggcttggaacggggttaatgactcgccctctgcagcacgaccagaccacatttcacggatactacgaggtaataaacgtaattgaactaagccagtggtaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaactaagccagtggtaatggtaaagaataaaccagcacctaaaagggttaatacagtaatatcccaaagtggaccgtcaatcgtgttcacgatccattttaaaacatcttcaaaaattgaaacgatgctatccatcgaaaagacctcataaaaaagtaaaacaatttcgccattttaacgattttttatcttttgaaaagatttttttaattaaaatgataaaaaaagttaatgattagttatttagcgagctggactggtttaaataacaaattctgtctaattagcaaataatacaagggacaccacgctcggcgtccattgaatatgacataacttaacgcttaaacaaaagattttggcttgtatctaacaaactactgtggaataaggtaaaaccaaaaccgatcaaaagtaatccaatcagcaattttccgaataaaacagaccgcttgtgagcagaaaatgaaagataccaatggctaatatgcaccgctttacggcgagcgaaaagtaccaaacaggcaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacagccacaatctgcagaatgttgatgatgagcagtaataagcggtgattttggggctattttttgcaaatggcgaatttgaaagccctttggctttgctctcacgctttttaacgcttgataacaccaataaagcccaaacaacatcattacaacaaaactgcctcgctcaacccattttaacgctagattaaaatagctacgagaaagggtaaaaatcaccacaataatcgtcactaacccaatcgccaccaagccttgcactaacgcagacaacaacgtgattttcaccgcttgtggcagtttggtttgttcaaaagagagatagctggtcagaataaacttaccgtgacctgggccgacggcgtgaaacacgccatagataaaactcaccgccattaagctcagccctgcctgttgctggttttcgtttagacgatttaacgcccctgaaagggcaaaattaaattccctctgccactcgctgactttaaataagagatagggataagcctgataaatcgcaaaaagagccaccaatccgaccgctatcccagcccaatactttgcctttattgacatacaatactcactttttgcgcaaattgtgcgcctaaagacaagccacgttctgctggcatatcgggggtttcatttttatctaatgtcgatgcatacaaccgcaaagattgatttaccgtcggctcaatcatctcaactttacaaagattttgctctgtgctactgacatcactcgctttttcgtaattcattgctaagtaataacttggctcaaaggtaaaaaaacggaatgactgcccaaggtgaaatggtaaataatacgattatgctgaatttcaacggacgagttatacggtttagctttaaacttaatcggttcattttgctgattataaagctcgctaaaatagtgggtactcaccgcagattcatctaactcacgcaaaattttattcattgcctgttttttatccttactgctgttgatttcatagatcagttcagctgatgtaatctcatcaagtgtccagtacaattcaaaaccttccagcttaccttgttgaattagcactttatttttcatatcaaggaaagagtgtggatgagcaaaaacagaaaaagagagtaacagcgaaatcgtgccgataagaaaacgcttaagcatttgaaatccttataatgaaatcaattttaaaatcattatatcagacttttataagggctttttgttccgacatgcttcaataaaaaagcgaacagacaaaatctgttcgctcttaaaaattaggctgagtcggtcgataagccgagttctgtcgtggacaatcattcctctaggcgtacattcacacatacgctcgagcaacctacccgaatcccaagcgggcaactcgttggattcctatttggtcttgctacgagtggagtttaccgtgccgtgaaatgttaccactcacgcggtgcgctcttaccgcaccctttcacccttaccagcagaaactggcggtctgctctctgttgcactagtcgtaggctcacgcctcccagacgttatctggcactctgccctgtgtagctcggactttcctctcgtttacttgtcccactaggtcgttcttacgaacggttaagggcttcaataaaccagcgattgtctaaccaactcaggctggcgagtatagcggatttatgaacttttgcaacaaaatgaattgtctcatccctattatcaacgttgattgaatcacttggaatatatgatttatattcaacaattttcaaattaatgcatacaagccagctcttttctttaatgtattatgctaccaagtcttatcctcttgacgagcaatccccttatgtcttaacaacgcatctaacgtaggtttgcgaccacggaagcgttcaaacaagaccatcggctcttctgaaccgccacgggttaagatattatctaggaaagactgcccaacctcacgattaaaaataccttcctcttcaaagcgtgcaaaggcatctgccgataatacttctgcccataagtagctgtaatagcctgcggcatagccccctgcgaagatgtgggagaagctgtgtggggtacgcacgaaagtcggtaattccaccactgcaacctgtgcttttaccgcttttagcgtatctaacacaatattttctttcggctcactcatatgtaaacggaaatcgaataaaccaaattctaactggcgtaacacaaacattgctgcttggaagtttttcgctttcagcaactgggtcaatttctcttttggtagtggctcgcctgtttggtaatgtcctgaaataaaggcaagggcatcttcttcccagcaccagttttcaaggaattgacttggtagctcaactgcgtcccacggcacgccgttaatccctgaaacgtcacccacatcaatttcggtcagcatatggtgaataccatgcccaaactcgtggaacagcgtagtaacttcatcgtgtgtaaacagagctggtttatcgccaatcggtttattgaagttacaggttaagtaggcaacaggtttttgtaatgaaccgtccgctagacgtttttgattgatacaatcgtccatccaagcaccgccacgtttattttcacgggcatatagatccaaatagaatgagccacgcaagcggtcagtttcatcgaaaatattgaaaaaacggacattctcgtgatagctatcaaattctttctgctcctccacccgcataccaaaaatgcgtttcaccagttcaaataaccccgaaagcacacgttcttcagggaaataaaggcgcaactcttcatcgttgatcgcatataaggcttgtttctgtttttcactataaaacgcaatatcccacggttgtaattcgcttacgccatatctctcttttgcaaaggcttttagctcagctaactcttttttgccttgctctttagaacgatttgctaaaccttccaagaaatcaaccacttgcgttgggttttccgccattttggttgcaagggaaagctcggcatagttttcaaaaccgagtaatttagctaactctaagcgtaactcaagggtttccgccataagtgcagagttatcccatttacctgcatttggaccttgatctgacgctcgtgtgttataagcttcatacattttctggcgaagctcacggttttcacaataggtcatcacaggcaaatagcttggaaattcaagggtaaagcggtagcctgatttctctttactttgtgctgaaagtttcgccccttcaagtgccgactctggcaagcctttcagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaatatcccaacccattgttgcatcaaggacattgttgctaaattgtgagctaagttcagataaacgagcagaaatttcgccatagcgtttttgtttatctgctggcaatgagatccctgataactcaaaatcacgcaagctgttttcaatcgcttttttctgagcgagcgaataagtggcaaactcagggctatttttcagtttgacatagccttgatacaacccctgatgttgcccaacccaagtgctgtattcggataacatcggcaaacacgcttgataagcttcacgcaattcagagctattttttactgaattgagatgcccaacaggcgaccacgcacgagagagtttatcccctgtgattgcttgcggtaggtagaagttttcccacgttggtgtattaatttgagaaacttgttcaatcgtatcacggcattgttgaattaactgctcaatagcaggcacaacgtgttcaggttgaatttgagagaatttaggtaaacttgtgttgtttaaaagtggatttgacattcgatttcctctttatttgataaaagtgcgacatcttaccattttagcgattattttcattagttgattgtgatttatgggggaagccgttaaaatttcagttatatacaaactgcaaactgcaaaaaattaaacacaaccgaccgcttaggaaaacgcaatgtctttagatttatcggatattcgacaacaaatcattcaaattgaccgcaacttattgaaattattatcggagcgtcatcgacttgcgttcgatgtagtgagaagcaaagagatcacgaaaaagcctctacgagatatcgaacgtgaaaaacaactgttacaagaattggttagttttgctcaagcggaaaattatcaacttgacccacaatatgttacgcaaattttccaacgtatcattgaagactctgtcttaacacagcaacattacttgcaaaataaactgaatcagaatcaagaaaatgccaccattgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttaggtatgcgtggctcttattctcatcttgcttctcgccagtttatgaaaaacagcacggcttctttagtggaactcagttgcgaatctttcgattcagtttttgaaaaagttcagcaagatgaagccgattatggcgtgttgccgttagaaaataccacatcaggttctatcaatgaagtttatgatttgttgcaacatacagacttaacccttgtaggcgaattagcttatcctattaaacactgtgttttaggaacaaacaatgctgattttgcccaagtggataccatttatacccacccacaacctgcacaacaatgtagccaatttattcatagtttagataaagtgcatatcaaatactgtgaaagtagttctcacgctatgcagttagtggctcgtttaaataaaccaaattgcgttgcgttaggtaatgaagatggcgggaaattgtacggtttaagcgtgttaaaaagtggtattgcgaatcaagaaaacaatattactcgctttattgtagtgtctaaaaaaactatcaatgtttcgccacaagtacagaccaaaaccttgttattaatgacgacgactcaacaagcgggtgctttggttgatgcgttgatggtgttcaagcaacacggcattcgtatgattaaacttgaatctcgacctatttatggtaaaccgtgggaagagatgttctatgtggaattagatgccaatattcacaatgaaaatacccaaaatgccttgaaagaacttgaaacagtgacgagtttcttaaaagtattgggttgctatccaagtgaaattattgagccagtccaaatcaacaatataagttaggaaatctcttagatattcctagtatgttacttataatggcagctgccaattaatttcttcgactccgtgagaacgaaggtaatcattggtttttgaaaaatggcgacagcctaaaaagccacgatgtgcagagagcggtgatgggtgaggggctgtgagaacgcaatgacgagaacgatcaataaattgcccttttttctgagcatggcttccccaaagcaaaaataccagattttcacgatgtagattgagttgatggatcaccttatcagtaaaggtttcccaaccgatattggcgtgtgaatgtgcttttccttgctcaacggtgagaaccgtatttaacaatagcaccccttgttttgcccactcaatgagatagccgtgtgatggtatttgaaacccaacatcttgggataattctttgtacatattaaccagcgagggaggcggaacaattcctggttttactgaaaaagataaaccgtgtgcctgattggggccgtgataagggtcttgccctaaaataactaccttcacatctttgaattcagttaaagcaaaagcactaaacacttcattttgaggtgggtaaattacttttccaactaaacgttcttgatgtacatattgcaaaatatgttgaaaatagggttgtgttttttcttccccaatggcatcagtccaactgttcatattctatcctattattaaattgttaaaaattaaaatgaactgttaactcttgtctattttttaagccatcatcagtttttttgataaaaatgcttaaatttttctcgctttttaaaggattaaagttagaatactcaaaattttttgaaactttaaactttttttataatttacccaacatactaggagctaaaaatgatcaaaggtgtacaaatcactgaatctaccaacaaaaacttattaaactctttctggttattagatgaagagaaaaatgaagcacgttgcttagcagctaaaggtgatttccaagaagaccaaatagttgcaatcagcgaattaggtcaagtttcataccgtgaagtcccagttaatgttgcaccaaccattaaagttgaggggggtcagcacttaaacgtaaacgtattacgtcgtgaaacattagaagatgcagtgaaaaaccctgagaaatatccacaattaactatccgtgtttctggttatgcagttcgttttaactcattaacaccagaacaacaacgtgatgttattactcgtactttcactgaaagtttataattacatcttttctcaggccctaccgtaaggtagggctttattgtatctattttgacatagtagcagatatgttttctactatatcattattttaaacccaatttcttctcaagatagtggatattcgttccacccttgcagaagttttcatcagaaagaatctgtttatgaagtgggatattggttttaattccttccacgatcgtttctgacaatgcattttccatacgacgaattgcaatatcacgattttcagcaaaggtaatcaatttaccaatcattgaatcataatgcggtgggactgaatagctagcataaatgtgagaatcccaacgaacacctaatccacctggaacgtgtaaacgggtgattttacccggtgatggtaagaatgtacttgggtcttccgcattaatacggcattcaatcgcgtgaccacgcactttaatatcttcttgtttaactgagattggtaaacctgcagcaacacgaagctgttcttttacaagatcaatacctgtaatcatttctgtgacagggtgttctacttgtaaacgggtgttcatttcaatgaaataaaactcgccattttcaaataaaaattcaaatgtacctgcaccacgatagccgatttcacggcacgcattcgcacaacgttcaccgataaactgacgtaattcaggggtaatgcctggcgctggtgcttcttccaccactttttgatggcgacgttgcatagagcaatcacgctctgccaaataaaccgcattgccgtgtgtatctgcaagcacttggatttcgatatggcgtggattttcaaggtatttttccatataaaccatatcgttattaaaggctgctttcgcttctgctttggtcatcgcaatagattcttccaaatctttttcgtgatgaaccacacgcataccacgaccaccgccgccaccagatgctttaatgatcactggataaccaatcttctgtgcaatttctttatttttggcgacatcattaccgatagggccaccagaaccaggcacacaaggtacgcctgcttttttcatcgcgttaattgcagaaactttatcgcccattaaacgaattacatctgctgttggaccaataaagataaagcctgaattttctacttgttctgcgaagtttgcgttttcagataagaaaccataaccagggtgaatcgcatcagcaccagttacttctgcagcggcaataatcgcaggaatatttaagtaactttttgtcgatggcgcaggaccgatacatactgtttcatccgcaaggagaacgtgtttcaactcacggtctgccgttgagtgaacagcaaccgtcttaatgccaagttcacggcacgcacgcagaatacgcaatgcaatttcgccacggtttgcaatgacaactttttctaacataagagatacccttaattgaaagcggtctttttcgtgcaattttttgcaaaaatctgaccgcttgtaagaaatggattattcaataatgaagagtttctgatcaaattcaaccgcttcgccgtcgtttacaaggattgctttgattacccctgctttgtctgactcgatacggttcatcattttcattgcttcaacgatacaaagtgtgtcgcctactttcacggttttacccacttcaacaaatggagctgcttctgggcttgggctacgatagaatgttcctaccattggtgaaagaatcgcgtgaccagatacttccgctgttggtgctggcgctgccgcaggtgctgtttgagctgctggtgcaggggttgctgcaggtgctggcgctgcttgtggtgcagcaacatattgtactgccgcaggtgcaactgctggtgctgcacggctaatacgtactgtgccttcttcttcagacacttctaattcagtaatgcctgattcttcaactaactcgataagttttttaattttgcgaatatccataatgagatccgtatttgaatgtaaaaataaacaaactctatgttcaaagaacatagagcaaaattttgcgtagattacctgaaattttattaatttgcgacgaaaatctgataaatttgccgaatttattagcaaatttgccactaatcgtagcagttcagttttctttttttacttcagacaacaaaaaatggatttatttccctctctttagaaattgaatagcataatctaaggcgtaatcgtaaccttttgcccctaatccacaaatcacgccttttgcgacatcacttaaataggaatgatgacggaaaggttcacgggcgtgtacgttggataaatggacttcaacaaaaggaatagcaactgacaataaagcatcacgcaaagcaacgctggtatgagtagacgcaccggggttaatgataatgaaatcggtattttggaatgattgatgaatacggttaataatcggctcttcgccatttgcttgaaaatactctagacaatagcctcttgccttcgctaattgttggaggtggttttcaatatcggctaaggtttgtgaaccataaatatggggctctcgtttccctagcatatttaaattaggtccgtttaataacaagatttttttcattatattatccttacaagcggttaaaaatgagcaagattttgcaatgttatcaaattctaaccctcgccccttgtgggagaggggcagtttttgcttcgtttacaagaaaaaacagggagaggggagagaatttagctacttatgttgtaattacttttatcattcaacattcgaacaacttaatggatataaattcaatttttccatcagcactctatcgccatcttcttctgggttttccgtcgttaataatttatccccataaaagatcgagtttgcgccggccataaaacacaaggcttgcatggcttctggcatattgctacgcccggctgaaaggcgaacataactttttggcatcgtaatacgcgcaacagcaatggttctcacgaattctgtccaatcgagatcttctgcattttcaagtggtgtgcctgccactttaaccaattggttaatcggcacgctctctggttgaggatcaagattggctaagctggcgataagtccggctcgttcagctcttgtttcattcataccaacaataccgccgcaacagatttttaaccctgcggagcgcactttacctaaggtatccattcgatcatcgtgagaacgagtgtgaatgaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgatagcgttccggatcggtatctaaattatgattgtagtaatctaatccggcttcttttaaatcttccgccataccttcttctaacataccgaaagtaccgcaagtctctaaacctagggatttgaccgctttaatgatggcggagaccgtctcaatatctttaggtttaggacctcgccacgctgctcccatacaaaaacggcttgctcctcgagccttggcaatttgggctttctcaacaatatagttcacatcaagcatactttgcttttcaacacccgtgtcatagcgggcagattgtgggcaatactcacaatcttcagcgcaaccgcccgttttaatggaaagtagcgtagaaagttgaatggcatttggatcaaaatgttgtcgatgaatttctgccgcccgaaaaactaagtccataaaaggcaaatcaaaaagttcttcaacttggcatttacgccaatattgtgccgttggatgcggcgtgagctcatttttggcttttaaacgtagcgaataggtcgtcatacaagatctccaaaaaagaggcacaagccgttgcttgtgccattcagtgcgaaaattactcttcgatagaacgtaataagtcgttaagacccactttacctaatgttttcgcatccacttttttcacgatcactgcacagtataagctgtgtgaaccatcttttgcaggaaggctacctgaaaccaccacagaaccggcaggaacacgaccgtaatggatttcgcctgtttcacgatcatagattttggttgattgaccgataaacacacccattgaaatcacacagccatcttcaacaatcacaccttctacgatttcagaacgtgcgccaataaaacagttatcaccaataatcgttgggttagcttgtaacggctctaacacaccgccgatacccacgccacctgataaatgcacgtttttaccgatttgcgcgcaagaccccaccgttacccaagtatccaccattgtaccttcaccaacataagcaccgatgttcacaaatgatggcattaacaccacgtttttctcgatgtgtgaaccttgacgcacaacggcacctggaacagcacggataccatctgctttgaactgctcttcgctatattcaccgtatttggtcggcactttgtcgtagtatttagtttctgcaccatcaatgatttcgttttcgttgatacggaatgaaagtaaaaccgcttttttcacccattgattaacaacccattcaccatcaattttttctgcaacacgcagtgaaccattatctaatcctttaatcacttcttcgacagccgcacgagtttgtgcatcaacagtttttggagtaatttcagcacgacgctcgaacgccgcttcaataattgcttgtaatgacatttgcatttccttcttgtaagttaaataaaaacggcgaacgttttaacatataagcggtgggattgctactaaatttcaccaaataatgtaatagatacatataagcggcatgattctacggattttttacaaatccagattttctctttgactagttacttcaaaatctgtaatattcgcaccctatgcaaaaggtaaaactacccctaactattgacccatataaagacgctcagcgtcgaatggactacgaaggctacatttctgcgaacctacttagccgtttgggtgaatctgttggtcaagtgctgggcgatgcacaagttactttatcgttatatgttgatccgcaaaaactcacagtggttaaaggcactgcgaaagttgatgtggagttagactgtcaacgttgtagtaacccatttacgcaaagactcgactgcacattttgtttcagtccagtgtctaatatggatcaggcggacaatttgcccgagatttatgaaccaattgaagttgattcttttggtgagataaatttgctagatatgatagaagacgaattcattctgtcattacccctagtgccgatgcataccgatgaacactgtgaagtgtccgaaagcgaattagtttttggcgaattaccagaagaactggcaaagaaaccaaatcctttcgcaatattagctaatttaaagaaaaactagatctagtaggagtatagccaatggctgttcaacaaaataagaaatctcgttcacgtcgtgatatgcgtcgttcacacgatgcattagccacagctgcagtatctgtagatgcgcgtggcgaaacccacttacgtcaccacgttaccgctgacggttattaccgtggtcgtaaaatcaaataatcaattggatctcgtagaggtttaaattgactcatctaactctcgcgttagatgcgatgggcggggactttggtccccgtattactatccctgcattatcacttgcgttggctcaacatccaatactcagttgcatcttgttcggcgaccaagctgaaatatccccctatctcaataaactttctcccgatattcaacaacgtatcgaattagtccatacaacaaaagtgatcgaagcagacttgccttttgtgcaagcgattcgtcaaagtaaaggcagttcaatgcgtttagcgattgaagcggtagaaaatggaaatgctcaaggctgtgtaagtggcggaaatacaggtgtactgatgggactagcaaaacaattgattgaacccttgccaaacattgatcgtcccgcattaacatctttgattccaacaattaacggcaactcaagtgtgatgttagatcttggtgcaaacgttgaagcagatagtgaactattgcttcagtttgcggaaatgggcaatgtgtttgcagaagtgatgttggatttggtctatccacgtttagcgttgctgaatattggaacagaagagcataaaggaacacagcaaattcgagatgctcaccagcaattaaaacaatgtaatcatctaaattacattggcttcttagaaggggataaattaatgaatcatcttgctgatgtgattgtctgcgatggatttagcggtaatgttgcacttaaaacacttgaaggtgcggcaaaaaatatcctttcactctttaaaaaaacaacggaagattcacatctttgtcgcaataccaaacgttatttactacgtttaatcttttatcgttactataaaaagctacaacagatcaaccctgatcgccataacggtgccacactgctcggcttatcgtccgtggttgtaaaaagccatggtggggcaagtgagcgagcgtttttctatgcaattgattacgccaaacaacaaattaaaaataacatccctacaaaaatctcccaaagacttattctaaacaattaagctcgctgtatcacaggtaaagttttattcagaaaaaacttttcttttttttaaaaatcgctactatacgccgtcctcaaatataacccaacatttgaggcgttgtttccaacctatccaatcctagggagcaatagggtaaaaacaaaaaagctgaaacgctttttttaataagtagcgagtcaaatgccccaaggcatcttatctttcaggataagaaagcttaggcttcccgcaaggcacccgacttatttttttaacctcttatagaaggtctattttcaaatgacaacaactcctgtaaatccgatcaatcaagcaactaacgaatattacttaactcgtcaaaacgaaatggaatcgaatgttcgtagttatcctcgtaaattaccgcttgcaattgcaaaagcacaaggttgctgggtcactgacgttgaaggtaacgaatatttagattgcttggctggtgcaggtactttagcactcggacataatcacccagccgttattcaggctattcaagatgtattagcaagtggtttaccgcttcatacccttgatttaactacgccgttaaaagatgcttttaccgaagaactactctctttcttcccgaaaggtgaataccgtttacaattctgtagcccttctggtgcggacggcacagaagcagcaattaaattagcgaaaacctatacaggtcgcggtaatgtaattgcattctcaggtggctaccacggtatgacccacggttcgctctcaatgacaggtaaccttaatgcgaaaaatgccgtgcaaaacttaatggcaggcgtacagtttatgccatatccgcacgaataccgttgcccgttaggtatcggtggcgaagcaggtgttgatgctttaacttactattttgagaactttatcgaagatgttgaaagcggtatggtaaaaccagcagccgttattcttgaagcaattcaaggtgaaggcggtgtagtgactgcaccagtgaaatggttgcaaaaaatccgtgaagtaacgaaaaaacacgggattgtgttgattttagatgaagtccaagcagggttctgtcgttcaggtaaaatgtttgcctttgaacacgcaggcattgagccagatgttgttgtgatgtcaaaagctgtaggtggtagcttaccgcttgctgtacttgcgatcaaaaaagagtttgacgcttggcaaccagcaggacacacaggtacattccgtggtaaccaattagcaatggcaacaggttcaaagatcaatggaaactgccgtacaagcggtgagtaactggctacaaaatgaaaaaatgtacactggcggtagcattaaacagctacgctcagaaattgcctttaacccgccaaaagaaggcttaggcgttgctaaatccctagatcgcttaattgaattattcctcaacaaaagtttaaaagtacaccacccacactctttggctcatttacactgtccaacaatggtcaccagccaaatcgccgaagtattaatcaatgccaccaatcaatcaatggactcttgggatcaaagcccagcaggttcattaatggaagtgcaactcatcgagtggttgcgtgaaaaagtaggctacggcaaaggacaagcgggtgttttcacttctggtggtacgcaatctaacctaatgggcgtattacttgctcgtgatgcgtgcattgcaaaacactggaaaaatgccgacggtacagaatggtcagtgcaacgtaacggtattccgcctgatgcaatgcaaaaagtaaaagtggtttgctcggaaaatgcacacttctctgtgcaaaaaaatatggcaatgatgggaatgggattccaatctgttgtaactgtaccgtgcaatgaaaatgcccaaatggacaccaatgcgttggaagcaaccttagccaaactttatttagaaggcaaagttgtggcttgcgttgtggcaacagcaggcacaacggacgcaggggcgatcgatccactcaaagccattcgtgcgattaccaacaaattcggtgtttggttacacgttgatgcggcgtggggcggtgcattactgctatccaatgaatatcgccacttcctagacggtatcgagctcaccgactcaatcacccttgatttccacaaacacttcttccaaagtatctcttgtggagcgtttttattaaaagatgaaaacgaataccgctacatcgactacaaagcagattatctcaactcagagtatgacgaagaacacggcgtaccaaacttagtggcaaaatcactacaaaccacccgtcgttttgacgcattaaaattatggtttacggtggaagcccttggtgaaaatctttacggctcaatgattgaccacggcgtgaaattaactcgtgccgttgcagactatatcaaagcgaccgacggcttagaactattagttgaacctcaattcgcttccgtgttgttccgtgttgtaccgcaaaactacccagcagagtttgttgataccttgaaccagaacgttgcagatgaactctttgcccgtggcgaagcgaatatcggcgtaaccaaagtgaacaacatacaatcgctaaaaatgaccaccttaagtccaattgcgaccttagaaaacgttcaggctttattagctcaagtattgagtgaagcagagcgtatcaaagatgcgattgcgaaagctgaatatacaccagcgattgattaaacataaagagtttctaggatgatgaataaaaattaatttctacgctataaaacgaataagaaatcatcaataactcttttatttagttcatttttagttaaattcatgctaaccctataaaatagataacaccctattttatagggtaattttttatttatccctaagatttaaacaattagtaagctgataggaaaaagatgacaaacagcagattgcgtactaccatatagcccaattttattggataacgagttcaaatgatgcaccgtagatttcaaaccattgcgattgtcggcaaacctcgtcacgatatagctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaacgcatttagctgtgtataactggctaaaagatcgtaaatataatgtgttagtcgaagaaaaaattgccactcaactcaatttagctaacccgatgaacattgcagaaattggaaaatgggcggatttagtaattgtgattggtggtgatggtaatatgctgggtatggctcggcaattagcgaaatatcgtgtaccactgattggcattaaccgtggaaatcttggttttttaacagatattgcccctcaaacagcctttgagcaactgcatagttgccttgagcgtggcgagtttatgattgaagaacgtttcttacttgatgcgaaaattgagcaaaatggtaagatcattgaagcaaataatgccctcaatgaagttgtcgttcactctagccaaatcgctcgtactattgattttgaagtgagtattgatggcaaatttgctttttcgcaacgttccgacgggttaattattggaacacctacaggttcaaccgcctattcgctttccgccggtggcccaatcttaacccctaatttaaatgcgattgctcttgttccgatgaacccacacagcctttcttctcgtcctttggttgtcgatggcgatagtgttatttcaatgcgttttgctgagtacaatcagtcaaatttagtgattagctgtgatagccaacgtttactgccgtttagccctgatgaacgtattcttgtgcaaaaaagcccggataagttgcgtctattgcatttaaaagattacaactactttaatgttttaggttcaaaattgggctggttgagtaagttattttgacataatatgtttcaaaaaattggcatagcgactattttgtctactatgccccaatattgctgggaataatcccctaaatgatttcttaaaattttaatttttgtacgactatcgtataacatcagaagttgcatttagcgcctgacgctgtgcttcaaacaactgctcaatccctttctgtgctaaatcaaggagttgcaataattccatatggctgaacggttcaccttcggcagtgccttgtacttccactaaacgaccgtcttcaaccatcaccacattcatatcggtttctgcgttagagtcttccacatattccaaatcacagaccgcttgcccatcgacaatccctacagaaattgccgccactaatcctttcatcggattttctttcaataagccatcggcgatcaatttgttaatcgcatcgtgtaacgcaacgcaagcccctgtgatagacgctgtgcgtgtaccgccgtcggcttgtatcacatcacaatctactgtaattgtacgctcacctaaggctttcaaatcaacgactgcacgcaaagagcgagcgattaaacgctgaatttccattgtacgaccgccttgtttgcctttcgccgcttcacgttgggttcggctatgggttgctcttggcaacataccgtattcggctgtcacccaaccttgttgttgccctttgagaaaacgtggtacagtttcttcgacagtggcattacacagcactttggtttcaccaaattctaccaacacagacccttcggcatagcgagtatagttacgagtgatttttacaggacgagtttgatcaacaggacgattatttggacgcatatttattccctttctctaaaaaatttcccctattctagcagaataccaagtacaatatgccaaattttgtaacaaagagaaaagagtacaatgatttacagtatgaccgctttcgcccaccttgagcttaaaaaagagtggggtaacgccgtatgggaaatccgttcggttaatcaacgttttttagaaacttatttccgtctgcctgaagcctttcgcaatttggaaatgaccttgcgtgaacgtctgcgtacgacactaacccgtggtaaagtagagtgtagtttacgcattgaattaaatgctaatcaaaacaatggcttagctttaaatcaagagtatgccaaacaggtgataagttcattacaatggctaaaagaaacggctcaagaaggcgaaattaacttggtggatattctgcgtttccctggggttgtcgataaccaaaatcaagatctcgaccagatcagccaagatttattatacggttttgagcagatccttacagaatttatcgcaatgcgtggacgtgaaggggcgaatttacaagccttaattcaacaacgtttagacgctattgccacagaagcgacaaaagtacaggctcaaatgccgagcgttttacagtggcaaaaagaccgcttgcaacagcgttttgatgaactgaacttgcaacttgatccacaacgtttagagcaagaaatggtactactggctcaaaaagtcgatgtggcggaagagttagaccgcttacagctacacgtcaaagaaaccacgtctattttgaaaaaaggcggtgcagttggacgtaaattagactttatgatgcaagagctaaatcgtgaagcgaatacgctggcatcaaaatcgattaacgctgatgtcactaattctgccgttgagttgaaagtgttaattgaacagatgcgtgagcaaattcagaatttggagtagtcaatgagtcagaccttaaccccatttcatacctttcatttgcctgcaaaagcatcggtcattatcgagttcaacagtattgaacaactattaaccgaatggcaaaaagctgatcacgcacaacaaccgattttattgttagggcaaggctctaatgtgctgtttttagatgattttgacggcacagtattagtcaataagctcaaagggatcgagcatcgtcaagacgaccactttcactatctacaagttgctggtggtgaaaattggcacgagttagtgcaatggacattgcaacaaggaattggcgggcttgaaaatctggcgttaattcctggtgttgctggctctgcaccgattcaaaatatcggggcttacggggtagaatttgagcgtgtttgcgattatgtcgatgtactaaatctcaaaacgggtgagctgttccgtttaacgaaaaacgagtgtgagtttggctatcgagaaagtgtattcaagcatcaatatcgtgagcattatgcgattgtggctgtcggtttgaagttagcaaaggcgtggcaacctgttttaaattacggttctttggcacaatttgatccaaacacagtaacgctacagcaagtgtttgatgaagtctgtgccgtacgccgagcgaaattaccaaatcctgatgagtttggtaatgcaggcagtttctttaaaaatcctgtggtggactttgcaaagtttcagcagattcaaaccgctcacccgaatattccacactatccgcaagcggacggttcggtcaaattaccttcgggctggttgattgaccaagcaaatttaaaaggcttccaaatcggtggagcggcagttcatacccaacaagcgttggtgctgattaataaagagaatgctactgggactgatgttgtggcactagccaaagaagtccgtcgtcaagtccgtgaaaaatttggcgtggaattacacccagaagtacgttttatgggacgacagggcgaagtggatagtgaatttgtgacaaggtgatcggtaatgggatttgatcaacatttaattacatcggcattaacgcaaggacaaactcttgtatttaaagagattgactctactaacgaatatctactgacgcactataaaaccttaccgtcaggctcactttgtgttgcagagtcccaaacggcggggcgtggcagacgtggacggcagtggtattcacctgaaagtcaaaacgtttatttttcaatgttatggcactatccttcattggatattccacagctctcatcactaagtttagtggtctcagtattaattgccgagaccttccaaacactgaacgtaccgcatattcaaattaaatggcccaatgatatttactatcaaggtaaaaaaatggggggcattctaattgagagccgtgtcgataaaacgggaatttaccttgtgattggcatcggcttgaatttaggaatgaacactgtcgataaaaatgtggtaacgcaggcttggagcgatctctcagaacatcagatagatcgttcccaactggttgctgagctagctaaacatttacaaaatgccctagtgacttacccacaaaccacctttgaaccctatgcggaacgttggcaacagtttgatattttccgtcatcaagcggttagattaatcactgaaaatgaagaaattcatgggatctcccttgggattaatgaagaaggggaattgattttacagcaaggagaaattatccgccgttttgcgacaggtgaaatgtcattgagaggaaactaatcgtccctatctcaattcatattttagggatgccgtaatcaaaagagttagtgaaagttagaaaaacagaaccaactcttttgtccactatgcttttttaggctgtaaaaatagttatatactttctagttgcttgcttcgttgaaaaatgaattgaattaacgtattatcaacatccatcactacttttcccttaaatacatgaaagcactattcatcttactcggttttatctcaatgatattaggtttaatcggtattattgtacctgggttaccaaccactccgtttttgcttttagcattatattgctttggcaaaggttctaaacgactaaaacagtggttcttatctaccactatctattccaaatatctcaagtctttcgatcaaacacgagccatgacacttaaacagaaaatcagtattttggcgttttctgtgccattctgtatttttgctttctttgtaatccctcacatcatcggcaaactgatcttaattgccgttattatctttcaatattattacttcatctttaagattaagactttagaaaaataggctctcaaggtaaaataacaagctgtctaaatttgcaaaaagagaaagaaaatgaccgcttgtttaagcaaagaaatcttaaaaattggcttagtttccgtgtctgaccgagcttctgccggtgtttatgccgatcaaggcattcctgaattacaggcttggttacaaactgccattaccacaccttttgagcttgaaactcgcctaatccctgatgaacaagcacttattgagcaaacattgattgaattagtcgataaccacgcttgccatttagtcctaaccacaggcggtacaggccctgctaaacgtgatgttacacccgatgcgaccttagctgttgcccatcgagaaatgcctggctttggcgaacagatgcgacaagtgagcctacattttgtaccaaccgccattctctctcgtcaagtgggggcaattcgacatagctcactgattttaaacctaccaggacagccaaaagcaattaaagaaactttggaaggggtgaaagatcaagatggaaaagtgcttgttcgaggtattttcagtgcagttccctactgtttacaacttttaagcgacatttatattgaaacttaccctgaaatttgtgagagttttagaccgaaatcagcaagaagataggataacttatgaaaaaaattgaagccattattaaaccattcaaattagatgatgtccgtgaagcattgacggacgtgggcattacgggaatgacggttactgaagtgaaaggctttggtcgtcaaaaggggcatacggagctttatcgtggggcagaatatgcgattgattttctgccgaaagtaaaattagaaattattgtggctgatgagcaagttgatgaatgtattgaagcgatcattgatacggcacaaacaggcaaaatcggcgatggtaagattttcgtgtatgatgtagaacgtgttattcgtattcgtacgggcgaagagaacgaagaagcaatttaaggaataaaatgaaaaaaacaggtttatcgtggttgtggttaagtgtcgtggtattaatcacagatttattgagcaaatacattgtggtacaacgctttgagctttatgaaagcgtgaatgttctgccgatctttaatcttacttatgtgagaaactatggggcggcgtttagcttcttagcggatcactcaggctggcaaaaatatttctttttaggtttagctattgtcatttctattgcattgattgtaatgctgtttaaaaataaagcggagctcaaactgcaaaattcagcttatgccttgattattggtggggcaatgggcaatgcggttgatcgtgcttataatggctatgtggttgattttttagatttttattgggacatttatcattatcctgtatttaacattgccgatattggtattgtggtgggggcaggattgctgattttagaatccattttagaacatcgtaaaagtaaaaagagtaattaaatgaacattattttagcgaatccaagagggttctgtgcaggtgtagatcgtgctatttcaattgtagagcttgcacttgaaattcacggcgcaccgatttatgtgcgtcacgaagttgtacacaatcgctttgtggtggacggattaaaagccaaaggggcgatatttgttgaagagcttgatgaagtaccagacggtgctattgtgattttctctgctcacggcgtttctcaagcggttcgccacgaagctaaacgtcgtgagttgaaagtgtttgacgcaacctgcccgcttgtaaccaaagtccatatgcaagtggctagagcgagcaaaaaaggcacaaaagcgattttaatcggacacgaaggacaccctgaagtcgtcggcacaatggggcaatatgataatgagaaagggggtattttccttgtagaagatgtggaagatattgctaaacttggcttaaaagaagatgaggatctgacttttatgacccaaactactttatctatcgacgataccagcgatgtgattgaagccttaaaacagaaataccctgcaattcaaggtccgcgtaaaaatgatatttgctatgccactacgaaccgtcagcaagcggtgagagaattggcgaaattagcacagttagtgctagtagtggggtctaaaaactcgtccaactcaaatcgtttagccgagttggcttctcgaatgggaacaccgtcacagttaattgatgggccgcaggacattgatccgaactggctacaaggggtaacaactatcggtattactgcaggtgcatctgcccctgaaatattggtgcagtcagtggttgaacacttaaaaacattgggtgttaccaaagttgaagaactggaaggttgtgaagaaaataccgtatttgaagtgccaagagagctacgcattacggaggtaaactgatgaatcgttttagaattgaatgggaatgccgtcgaggtatgcgtgaattagataaaatgattatgccgttttatcaagaacattttgatagtttaaccgctgaacaacagcgcactttcgtggaaatgcttcgctataccgatcccgaactgttccgctggtttatgaatcaagacacaccgccaacagaggcattgcaagagatggtgagattgattcaatcgaaattggtctattgagtaatgatatgtaggtaaagtatttagcatgttagataaaatggttgtttataatccctgtttgtgtgtgggaaaacccaaaagaactatagaaatattttctttggagctaacgttgatcagcccctattattaagacttatatcattatctaaatgaaaaaagaaaaatccgaatttcccttggcacaatctcgtgtggatgccccttttgccaaaggcgtgttggcgtggtatcagcaatacgggcgtaaacatctgccgtggcaacaaaataaaaccttgtatggcgtttggctatctgaagtgatgttacagcagactcaagtggcaacggttattccctattttgagcgttttattcaacgttttcccactattattgatttagcgaatgcacccattgatgaagtgttgcatttatggacggggttaggctattacgcaagagcaaggaatttgcataaggctgcacaacaaattagagatgaatttggcggtcaatttccgacagattttgctgatgtgtttgcactttcaggtgtcggcagaagtacggctggggcggtactctcttcggtacttgatgcaccttacccgattttagatggcaatgttaaacgtgtgctttctcgttattttgcggttgaaggttggtcgagcgaaaaaacggttgaaaataaattgtgggatctgaccgctcgtgttacaccaacttcgcaagtggcggattttaatcaggcgatgatggatttaggggcgatgatttgcacacgatctaagccgaaatgtttcctttgtccgttagaaaagggctgtcaggcaaatgctcaacaggcttgggcggattttccagccaaaaaaccgcaaaaggcgttgcctgaaaaacagagctactttttgattttaaaacaggggacaaaagtcttattggaaaaacgtgaagcaaaaggactttggggcggactttatgtctttccgcaatttgaacatttagacgatctcaagcggtcagtttcgggcaaaaatttgcaaatgacacaattaattgcctttcggcatacttttagccatttccatttggatatttatcctattttggcggaacttagtttacaaaaaaatgccgaagtcctaccgcttggggtggcagaaaatcagggaaattatcatttgcgtgtatcttcaacagcggattattggtatgatttaactcaacctagcgaagtgggtttagcaaccccgataaaacgcattttagacgaattaactttgacattaggacagaaaaatggcgcgtaatgtattttgtgcatatttgaaacaagaagcagaaggtttagattttcaactttatcctggggaattaggtaaacgtatttttgattcaatcagtaaacaagcgtgggcagagtggatcaaaaagcagacaatgttagtcaatgagaagaaactcaatatgatgaaccctgaacatcgtcagcttctggaaacagaaatggtgaattttttgtttgaaggaaaagaagtccatattgaaggttatgtgcctgtagagtcaaaatagagataacctaatgaacaaatataaaaaattcctgccgttattggtgctgatcccttttttagcatcttgtggaagtgatacgccgacgagaaaaggttctaaaaagcctcgccctgattattctaaaaataccaatggtttagatattttgatggggcaattttcacgtaatatcgatcaaatttggggcgttaatgaactgctccaagcaagccagaaagactatgtaaaatatacggacaaatattacacccgtagccatattagttttgaagatggtcaaattatcattgaaactttggcggatcacaaccgcttgcgtaattcgattattcacacattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggatcaatatgggcgttctgtaaccaatgtggcggttgctaatgattttgcaacttacctattgcaaaataaattaaaaacacgccgcttgaaaaatggacataccgttacttatgtcacgattccaatgattgcaaaccacgttgaagttcgtgcaagacgatatttgccattggttcgtcaaatgtcaaaacgctatggcattgatatgagcttaattctgggtattatggaagttgaatcagcatttaacccttatgcagtaagttatgcgaatgcgattggtttaatgcaagttgtacctcgtacagctggacgggatatttttgcgcgtaaaggttttggtggccagcctaatcgtgattatctttataacccaagtcagaatattgatgctggtacaatgttcttaacgattttgcgtgatgagtatctagaaggaataacggatcctacatcaaaacgttacgcaatgatttcagcatacaatagtggggctggtgcagtactgagagtgtttgataatgataaattaatggcgattgagcgaattaataacttagatccgtcagcaatttatcgaattttaaccaccgctcatccatcttcacaagcaagaaactatttggttaaggtaaataaagcccaacaaaaataccgtaacgtgagataacacgttgttttttaaacaaattgaataaaaagcgatccgttaaacagatttttttatttttttgaaaaaaacgtttgacgagaggggcggaaatcagcataatgcaccccgtaacgacgagatgcctcgatagctcagtcggtagagcaggggattgaaaatccccgtgtcggtggttcgattccgcctcgaggcaccatttatgttacaactcttttcctccttagttcagtcggtagaacggtggactgttaatccatatgtcgcaggttcgagtcccgcaggaggagccatatttttagccccgatgagaaatcatcggggtttttctttttctctatatatctaggcatagtagacaaaatggttgctaaaaaagtgacttaaagccttatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtcctctttttaaataattgtctgtcttctttcacaaagaaattacgtctgatagatatttagattgattacacaagtaaaacaaacctataaacaattagcagaaaggtatcaatgtttcattagagctactcaacattattttgcataaaaagaacagtagataccataatgttaaattttccccatccgtctttcgggcccttccccccgtttgtgggggaaggggttaatgagtaataaactaaggttcgatgaaagtaagcaggaagtttggtagagagggaactatctctccaacgctatcgccaacaaagtaatcgggtgtaggcaggttaagttggtggacatatcaatttgccatttacaggtttcgcactcggaaacgacatagtcaaaaccaccgttattgatgtgttggaacaacggattgccaatggcttgtgaagtttcatagttttccgctttgaagccgtaagtccctgcaataccgcaacattgtgatggtaacatcacaatttcaatccctgggatatgttttaatacatcaagggtgtaaggcgcccaacctgctttatcaacgtgacaagcggtgtgataggcaatgcgtaatggcatctgtttgaattttggttttttgccttgattaaacagttcatagagatatttggtgacgatatgaacgtgtgggcggactttggcgttgtccattcctaaaacgtgatgatattcgtcacgcaaattcattgtacagcttgatgatgtccctactacgtcaagctctcggttcatcaccactttttcaagttctgcaaggttgaatttcgcttgttgcttcgctctatctgggaagccgtttaccattaatggcaaaccacagcacttctctttttcaagtagcattacgccgatgtccatcgcgttaaacacatcaatcaactctttaccaagttgtggattgttgtagttcacataacagccgtgatagtacgccactttttcacgataaagggcttggcgttcttgctcttttttcatataccagttgcggaatgaaccaaaagcgtattttggcaacgagcgatgacggctcactttgatggttttttcaagcaagaatttggttgcttttagacctgtgatggtattgacaatcggggctaatggggtgttcattttgcccataatgtcggtgttgctcaaaatagcatcacgcagtttgtgcattagcggtttgttttggcgatctaaatgacggtttctcgctcgcacaataatgtcaccaattttgacatcagacggacaagctacttcgcaacgtttgcagttggtgcagtatttgagtgcttcatcataaagttcagggctttttaagcgtaaacgctcaccatctgggcctgattgtttcggacctggatacatcgggttattacgcgaaacagggcaaaccgccgtacaagcggtacatttaatgcaactttcaaaggactcatcaaaaccgtgatgaacaacggcagaatgggtattttgttgagcttgttcgattaaacgttgaatgttgttcatattatgcccccacaatttcttctgcaacggcaagtgccgttaccactgccacacctgagccacagcctaattcaaggctattaaaaccgccaatgacgttgccagttgcatataaattcgccataaattgcccatctttgcgaacttggcatttttcgttgatcgcaacccctgccgattgatacggttgtggcgatgaaaagcgattagccgtccacgacaagcggtcggtttcattgaaatctttgcaaccaacaatatcggcttggaacactggttcaaaaatgcgatcaaagtctgcttttaagccgttgctgaaatagcttcctgtggcgagtacaaaatgttctgcactgatcgcattgtcttggtgaagctgagtataaatccgttgtactttgccattttcaatatcggcttttaatgctctgtcgccgtttaacatcaaaccgcccaagcgttcaaaacggtggcgaagttgtttatgttggcgaataccgagcaatgatggcggtaaggttggtaattcaaaaatcgttgcttccaccgcttgttgtaactggttgaagaaactttgatcgtccaagccaaaacaagctggtaagaagatcgcttctgcccctttggttgccgttttgatttctgccacaagatcacggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttctgccacaagatcacggaaagccaatttgtgttctaacacttgagcgatattcacactacggaactcacgggcattgttacgcagttggtcaagctctggaatattgagatagccagtgcttaattcgcagtgggtaaattgtgggttctgttttaggttatcggctaacagttgtggttggaagtcgtgatagccttcgatccccaatatcgcaattgttttatagaggaaaggttcgctacctttgactgttggcacactgtttggcgataaccacgctccacgcaagccacctaaaggcgttactcgtaggtgattttgtgcggtagagccgaccaaatcgagcttgagcgatgtggcgagttgttcaaattgtgtcgctttggcaaggactttctctttgccaagtaagctgtaagggtgttgtggcaactgttttgcgaaagttgcataggatttgcaaaaatcagcgacaaactcaccgcttggtaaacggctgagtaaatccattgaacccgatgagaaatcaatcgccgcttgaccattgttgataatcacacaacgtttaccctgttcttgtagggcaaccccacaggttaagcctgcaagaccgccaccgataatgactacatcaaaattcattgctatctgtcccctgttgagcttgctctgcaagcggtttcacatcatttagacctaataaactgtaatagatccagctagtaaaatcggcttctcgaatggcatcgccccacgcaatcggctcaatcccacgccagcgttcttccataaaagaagccagttgagtggtggattgtcgtggtgttgccacttcaaaacgggtcatcagcccagcggcacggcaggcacagagttctgcttggcaggttcccataccaacgcgggtacggcgacgtagatcgacaagattattgacacttaactcgtccaccgcatagcgaacttcccctgcggtgaccgcttcacactcacaaaccagagagcggtcaagacgttctttattcaacaggcgagtagcacgagagccgtgacgataaactgcagaatagcgaatggtacttggcagtgaaatgacttttctgttggtttccgctcggctttcacttgaaccaggtaaggctttttctgcagtaacacagcggtcggttttgtttaattttttgcaaacaagatccgttgcccactcagccattaagcgataggtcattaacttaccgcctgtaatagtaataaagccttctaagccatcacgctcttggtgatcgagcaagacgataccacgactgacattacgtcctgatggatcatcatcggtagccactaacgggcgaaccccagcgtaagcacgcaatacacgggtatgtcttaaacttggtgcaagtttttcgccttctctaaagagaatatcgacttcttcaggggtgacgatcatattgtcgatttgatcgtaaggaatacggcttgatgttgttccaataacgctgatagtgtcgcctggcacgagaatatccgcatcggcaggcttacggcaacggttgatcaccattttgttgatacggtgtcccatcaccagcaatgcgcctttggcagggaacattctgattttcaaatcggcatactcagcaatgccttgtccccaaataccgccagcattcacaaccacaggggcaaagaattgacgttccactctgtttttatggtcgtaaacgttcacgccaatcactttaccaccttcacgaattaaccctttcacttcgcaataggtaaagactttcgcaccattctctgtggcatctaacatatttgatgctgtgaggcgaaatggatcaatggaaccatcaggcacaaccactgcaccgacaagggctggatttaccgagggctccatttgcatcgcaagttttggatcgatagcaaccgcttcaatgcctgactccgtacaggcttgaataaaggttttttgataggcgagctcatcttcaggcaaagtaataaacaacccttccgtttcatcaatacagtgacgagcaatccgacgtaagattttattttcttcaatgcactccgttgcagactcacgatcatttaccgcatatcttgctccactctgcatcagcagtggttggttgggcagcagagtactacggctgggacggtggcttctatgtaatgatcgcaggtggcgtattagcagtattgttaatgttcatcacaatgcttgaagaaggcaaacataaagcgaaattagaagatagctatggtaaataattaatgattaaaaggaagacattttggtcttccttttttatatctacaaaaagaggaaaacagtatgaaactcacaaaatttgcattaggtttagtcgcaacagcagtattagcaggttgctcaacatcaacctcagttgcaacacagtcagataaactgattatcgcacaccgtggtgctagtggttatttaccagaacataccttagaaagtaaagctctcgcatttggacaacaagcggattatttagagtaagatcttgcaatgaccgaaaacttcaaagtagaagatggtaaacaagttcaagtctatccaaaccgcttcccaatgtggaaatctgatttcaaaattcacacctttgaagacgaaattgaatttatccaaggtttagaaaaatccacaggtaaaaaaatcggcatctaccctgaaatcaaagccccttggttacaccaccaagaaggtaaagatattgcactggaaactttaaaagtgttgaaaaaatacggttatgaccaaaaatcagaccttgtttatctacaaacctttgacttcaacgagttaaaacgtatcaaaaccgaattgttaccaaaacttggtatggacgtaaaacttgtacaattagtggcttacactgactggcacgaaacggaagaaaaagacaaatcaggtaaatgggtaaattacaactacgactggatgtttaaaccaggtgcgatggcagaagtagcgaaatacgcagacggcgttgggccaggttggtatatgctcattgacgacaaacaatctaaaaagggcaacattgtttacactccattagttaaagagttagcccaatataagatggaacttcacccgtacacagtacgcaaagacgcactacctgagttcttcaccaacattgatgaaatgtatgatgccctactcaacaaagctggtgcaacaggtgtatttactgacttccctgatactggggtggagtttttaaaaaaaggtaaataaaaacgggttagactataaattttttaatagacctcactatctatggatgtagtagtgaggttgattagattattttaccctcaacttcgccaacacggcttttagttgtttatccaacggtgctgtcacgaccatttcttcgctcgttttggggtgaacaaatcgaatagaatgggcgtgtaaaaataaacggtttaaacccgcttgttgcattttttggtcaaattcacggtcgccgtatttatcatcaagggcaattgggtgtcctgcgtattgagtatgtacacgaatttggtgcgttctacctgtcacaggcgaagccttgactaaggtcgctatcggataacgttcttcaattacaaatcgggtctcggacggtttgccttcttcacttactcgtacaatacgttcaccactggctaattcgtttttcaatagcggtgctttaatcactttaacgtgcgattgccactgcccacgcacgagcgcgagataatctttctgtaccactttttcacgcaactgttcgtgcaaactacgcaatgcggaacgttttttcgctactaacaacagccccgatgtatctcggtcgatacggtgaactagctctaaaaaacgggcttgtgggcgtaacgctcgtaaggcttcaatcacaccgaagctcaaaccgctaccaccgtggacggcaatgcctgacggtttgttaatcactaacatcacttcatcttcataaagaatttgatgttcaagctctgcaactttgttgagtttggtccaaatcggtgcttcatttttttctgccacacgcacaggcggaactcgcacaatatcgtccgcttgcaacttatattcgggtttaatccgccctttgtttactctcacttcgcctttacgcacaatacggtaaatcaggctttttggcacgcctttgagcttggcgagtagaaagttatccaaacgttgcccagcttcatcatcactgatcgtaaaaaattgaacgctggcactaattactttttctgttgtcattttgatataaagaaaggaaaaatgaattggattttatcacaaattctgtctcgtgttagaataggctgaaattgatataggagaacataatgagtaccatagaaaaaacaaaagaaatcatacctgaaatcactttaccccctgaagcgaaagagattattactgatgtaaaaaatcttgaacttcaacaactcctggaaaattggattattccctatggcactaaattgttaattgcaattgcgatttttgttatcgggcgttatttggcaagggctatcagtacccttatcggcaaagcggtattagcatcaagcaaagatgaaatgctacaaggttttgttcgatctatcgcttattttctgtttttgctgattacagtgattgcctcactttcacaattaggcattaatacgagttcgttagtggcattgataggtgcggctggtttagccattggtttagccttgcaaaactcattacaaaactttgctgctggggtaatgctattaatctttaaaccatttaacaaaggcgattttattgaagctggtggtaaatcaggcaaagttgagcaaatggggattttgatgttggagctaagaacggtcgataataaaacggtgttgatcccaaacggtaaagtatttgccgacagtatcaccaactactcccgcaatgaaactcgtcgcatcgacttcattttcgatattagctatgagtccgatattgagaaagctaaagagattattgctcaaattctgtttgaagatgaaaatgttttacactatccagagcctaccattgcagtcggtaacttagcggcaagcagtgtgcagttatttgtgcgtccgtgggtacagacgaataactattcaactacacaatttgcgattttggaaaaagtaaaaattggctttgataaggctgggatttctattccgtataatcagttagatttacatttgcctgagcagacctcggtaacctttactaaatagtgaatcctaataattaggggaaaaaatatattctgttttccataaatagaatattattttgtgagttccccgctatttatagtggggctcatagaatttttcaggttatttaggtattattttttccgattataaatttccttagccttaggcactaaacgtgctaaattcgcttggcgatcttcgtttgacgggtgagtagaaaaaatagacaaacctgaactaccattcgcttggctcattttcacccacacatttggtgctgcttcggggttataacctgactctgccattaacatcaaaccgacttcatcggcttctgtttcttgactacgagagaagggtttattggcaactaaatccacccctgcactgagcaagccttctgtattcacgcctgttgttgcggtcactgcaacatcagcaagtacaccaacaatacctgtcactgtgctaacagtacgatctgatttgccatgttcttgcaaagcgtgagccatttcatgtcccatcacaaccgcaatctcgtcatcagataaattcaacttatccaccagccctgtgtagaatgccatttttccaccaggcatcgcccaagcattcaattcacttaatttcagcacaatgatttcccattgaaacggcactcctgttttatttgctcgttccgcataaagcttcatcttattgaaaaccgaatgaatgcgatgagctgtcgttgagctagtatctaacatactttttgctcttgcttcctgcttcactttagcataattactttctgcttcttgattaatttgggctgtgctaacacaagcggttaaaagtagtgaacaaattgctataacgctaagattcttgaaaaatttcatacttaattcctatcataaaaaatgccaaagcgtttactttggcattatattcggttaatagtttaattattttttcgcacgttcgaaagactctaagatctcttgacgagcttcattcacatcgccccaaccttcaactttcacccatttgcctgcttctaatgctttgtagctttcgaagaagtgttggatttgtgcttttaataatgctggtaagtcgcctacatctttaatgtgatcgtactctttggttaatttgctgtgtggaactgcaactactttcgcatcgccacctgcttcgtcagtcatttttaacacgccaactggacggcaacgaatcactgaacctggttgaagtgggtatggcgttggaactaatacgtccacaggatcgccatcagaagaaagggtatggtttacataaccgtagttcgcaggatagaacattgctgttgccataaaacgatccacgaaaattgcaccactttctttatccacttcatatttgattggatctgaatttgcaggaatttcaattacaacataaatatcatctggtaactctttaccagcaggtacgttttctaagcccattttggtttccttctattaaataagggtgaaaaattggcgagattataacggattcatttccaatcagcaaagcaagcggtgagattctcacaaaaatttgcaaaaaataatagggttctgaccgcttgtagtaatcaagtaattacccaccttaccgcaaacaaatgttcaaccttacgctgttgttctaatttatctcggatacgagcaaataacctatctcgctcttcctcaatttcctcttccacatcaaaaatatttgcccttaattgtcggcgttttttctctaaatctttcaattgtgtttcaaaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaagttgttctaaatttgctgcttggtttttctcacgtttgacttgtttgattttttcactcacttccacaatggcttcctgagcagccttgattttatcttctgcccatttatccaaacgttcgctttcttgttttaataacgccatttgtgtttcagcctgttttgcacttatgccctgaatagcttgattggcattgctttgtaagtcatcgggtaaagcaacattatctgcgtttacctgagccgatacgctaaacaattttcggcaaaaatcctcatctaaccattcacctgtatcggttctggcggtaaaaacaagctgttcctgtgtttggttttctccataaaaaccgagcttatccacccatagccaacctgattgtccttgatgttccgccaacacagataatttcgttgggtgccggctataatcaaactgcacacaagccacatcggtttgaacttgctgacaatactctaaacaccattcgcctaaaggatggtttaagcgataatcgtatcctgtctgcccctctcgttgttgcaattgatagcgtcccgtttgagctgtttcaataggcgattgttgcaagtaaaaggatttttgggcttcgtcaaatttcgcataatcttgtaatgcaaattggcttgcataccaaaaatagcggctggttttatccaataattgttggctttgggaaagctgtaacttcaagcgttcgtgcacatcttcatcaaaatggtctaacaaagccgaacttgccgtctgcattgcctcttggatttgtgtttccatttctttttgtaaatcatcaaaggcttgtttgatttcttccgcactgcggcaactatcgtaaatatgagcaatacgtttttcaaaatccaaacctgtttcaatacgccctagaatttcatcagatgcaccgaatacgccatcaaataacttaaatttttcgcttaacagttctaaaactcgttgatcggcttcattgcgttggttcaaaaagttaattactaccacatcaaatttttgcccataacgatggcaacgaccaatgcgttgttccactcgttgcgggttccaaggcaaatcgtaattgataagcaaggaacagaattgcaagtttaccccttcggctgctgcttcagtggcaatcataatctgtgcattgttcttaaagtgatcaatcaacgccgtacgcatatccacttgtggagaacctgttattcgaccggcattattttcatcagcaagccactgttcataaacgcgtttggcatcagtgtgatgattagcacctgaaaaactcaccacttgattggcatagccattggcaatcaaaaagtcatataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggcttgcgttcgcacactttctgtaaaaataatcgctttttgagctgcaccaagttccgccattttggcaaaaccggtttgtagtgcggttaaaagtgaacttgctttactatcgtggcgtaattgtttggtttgtgcgataaaaccttcaatttgagcgatttcatcatctagtgtttgacgatcatccgatgttaatccttcatcatcatttgactcatcatcttcccactcttcatccaactcatcggctaagtctgcttcactctctctcaaatcaagtaataaatattcttgtttagcctgttgttctttgagtgtataaaggcgttttaagataatgctaagcgtatccgccacggcataagggctggaagccaataatttacgcaaaatcaagccaatcaaatgacgttgtcgcttcggtaacgccaagctatgttctttgctgataaaatccgatacagcttgatataacgcctgttcttcatcgcttggatagaaattttgggtaagcgtatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaagcaaggtagataaaccataaagttccatcaaactgttttgcaatggtgttgcagtgagtagtaactttttacgcccatcaaatgccgagcgtaatgtttgccccattttattactggtacgatgggcattacgcagtttatgcgcctcatccatcacgacgcaatcaaacagttctccggccaaaaaattcgcgagtttggttgcatattggtaagaaataattatgactctcttgcccatgttggcttgcaaaaaacttggcaagctgccttgatattcttgttttaatagcgatttatccaaaatcacacaaggtaaaccaaacttttcagccaattcatttgcccactgtttccgcaacaccgcagggcagattaccaacaaacggcgttttcgttccgcccataattggcaaagcaccaaaccagcttccaccgttttgcccaaacccacttcatcggcaagtaatacgccacgcccaagcggatttttcagtgcaaataacgctgcatcaatctgatggggattaagatctactttagcattaaataaaccgtctgaaatacgagccactccattttcggaacgacacaaaatttcattggcaaaatacttcgcttgatacgctgtgatattcatacaaattttccaattacctactgcatcaacaaatgaaacaattcaacattaatataaaaattttcttttcctattttggttttcgctaaaacacctaaagcaaccaattcgtcaagacgcttaacggctgtattacgatggatttgacaatcttccattacaaagtcaatttttgtatagggatatttgaataaattatttaataattcatgactatacactttaggtaaattttcacgaatcatctgtttttgcttcatcattagagctttgatttcattaatcaatttaaccgattgaatagccgtttcagcaataccattaagcataaaaatcagccaaggttcccattgttgggtttctcgtactgcttgcaacaactgataatattcacctttgttgcgattaatgtatcgtgataaatacaaaacaggcgtatctaacaatccttgctgaatcaaatacaaaatattgataattctccctgtacgaccatttccatcgtaaaaaggatgaatactttcaaattgatgatgaattaatgccattttaaccaaagggtcataatccatttgttcagaatcgttgataaacctttctaaaccagacatcagattttcgatttcatcataggtttgaggtggcatatacaccacttcttgtgtggcttgattaactaaaccggttcctgcttgtttgcggaagcctgcgttattaccttccaactcacgctgtatctctttaattaaatttagggttatcaaaccacttttctgtacttcatgaaaccctaaattcattgcctgaacataatgatgaacttctttagctgccccagaagcaaattgctgtgtggcgtaattactctgatataagtcatcttgtgtggttacaatattctcaatttctgaactttcttttgcttcttgcaaaggcaaagtaccaagcagaatattgggatttggcatcgtatgcacgacaccttttaactcccctaatgcacgatgtgcgtgggtgcaggctttaaaaacagatttgctttccaaatctcccaacgcgaataaatcaggaatgacgtaattcatacttcgttctcatcaacataaaaattaggaataatgtgcacattcacacaacatacacaagaaatgctattttcctgtgtatgttattccgatatgcacacaaaatccacttttcttgtgtacgttattcctactttaccatttcaagcatctacaccactattgcagcatcattttaaacatctgtttgagataaacctgattgccgtccataaacaaaatatgtttatcggcaaaatcttgtgttgtaaaatgccccacattgagcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatgccccacattgagcaaatccgcctgtttggtaatcgacaaaataaaggcagacaaaatcggtgtctcaatcttcaattcacgcgctaatttttgcaactcatcgtgcagcccaaatttggcattgtctaaatccatattgcgaatgcctttcggatcaatcaagctaagccactgcttacctgtttgattgtccacaagccacagcaaaaagtcgggatagaaattgccagccaaagcaaaacccaagcctttggatttattggcagcgttgcgtaatagatacaaatctttgccttgcgtccactcgctcaacttgccacttgctttggcattgactaaatcactgattaaacgcaattcactttcatcaccaatggcaagcggttgaatactaaacggcaaatcttggcgttctaagcaagcaaaaatgggcgcatacaaatgtccatcaaaacagagcatttgcaaacctttgtcgccaccataaacaggttttaccccattgctaaactcgctaatgccgtctgctaaggcttctaaccgttgtttgatttcattaccttcgtcattatcaggcaaactaaattggtatttatccaacatagagccattgctgtcatccaccgtaaccacttcataaaactgcccttcgtaggcagcttttaagcggttataaaaggcttttacatattccaacaacaaatccgtcaaaatctcttgctgcaacgccacttgagcaaaactatccatctttaacgccgcttttggcatatacaaacgataccaatgactttgctcggcaaattggcgtaacttcgctttatctaatcgcaagttataccaagattgctgatgtttaaaacgtgccacttgcagataaatcttatcccaatcaaaaaaatcaaacagtgccgaatttaacttcacttcatcacgctgttcgccttgcacttgagtgattgccgtgcctttggtggcaaaactttgcacttttggatagcgatctaggctaatttcaatccctttaattttgttctgccatttttcaggaatttcaaacagataaatctgcttttctactcgcttaaacgactgcttacgattgcctttgacttcttctttgagttttaaggttttcagtttgatggcaggcaagcgtttttgtacagggaaatccaacgtcagcatttcatcgctggtttggatatcttcatcgtccaaatagccacggaacacttccatataatcggcattgataccaaaaatattgagcgtttccagtttttctaaaaagacacctttcgggcgaacgcttggcaatgaacgtttgagcgaccattcacgcccttttaatcgcacgccacgcccaaataactgaataatctggctaccttcgcctttgcccatattgagcaagcccatcgtagaaacacgccagcttgaccaaccttcggtaaacttacgcgaaccgattaagatatttacgggagatgttttatgattaatttcagcaaataaaccgccattaaactcatcgctcaccgcctcaaactcatcggcaaaattttcttgtgcggttttcagtaaaccagaagcatcgccgatattgataacaccaaatttctcgccttgttcgccaagggataatgccagttcgccatcgctttttttcaaatgggttaaacgcagacggcttgaatgtgtcgccccaaaaatcttacgcaacatatcttgatacaaagcatccacgtcatcgacaaaagagagtaatggcacaaaacgccctttgaaaaggtgttcattattcttacccaatatttgaggattatctagtatgagttctttcaaccacttttttacctgttgagattgattcacaaagaaagccagctgtcgaataacagttaaaatatcagatttttctactttttgttcttctgtttctttattactttctttaacacgatgccccacaaacaccatcaatggcttttcaatattccattccgccaatgtcgatttgtgttgttcaaacaaataaagttgttgataaaacgacaacaaacctgccacaaaataaacaggcaaatgcttatcaaaaccttgtttttcaatatttaaaatcaggctctctttaccatagccatcgtgataaaaatgcttataggaataatcaaacaacaccgatttagcataagtttcaagcactgcagtggtgcgaacctttgccatttccagctcatcaagggttaatttggctaagtcgtcttctgataaaccttttaacgaacctttattaaacaataacttggctttcgctttttgcttgtcttccacttgtttagcaatggttttgccgcctgccaccgcttgcccaagcgttgccgaatattcaaaggcaaaaccgcctttgactaaggcttcacggcgtaacagccactgttcgcccgatatgccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtccaccaacaccaaattattgccttcaaaggcttctaccgacacggttttatcgcccgatttgtcggcaagtttattgacatcaatgatttcaacgcacttgccaatgcccacttcatccacgctaaaattaaaggttgcctgtgccgtggtatttttatcaaaaaaactggcttgaaagcctgacaattcaagctcttctttatgctgacggcttaaaccttcgtttggggtaagcacaatcactttatccgggcgtacaagcggttggtttttaccgaaataatgcaaatactgcaaaatattgacgtgcattaacaaggttttgcccgaacctgtggcgttccaaaaggcgattttatttaaatcatttaagcgatactcttcaaaatcttgtgcttctttgcccatctctttggcgtattgtaccaactgctgattaagtgcggtctgcaactcggcttttttattaaaataccaatccaaataaatttcggtaaacaatagcgatagatactggaagtattttggacgcaaaatatgaccgcttgtgcgattacgcttttccgtgattttttgccaataatgcaccaaccgcaaatcataagcggcaagctccgcaaggcttagcggattgtcgtgttcaaaaaacagctcattgcttaggcgatgataaaaatggctctgtccatcgctggcgatatagtcgtcattttctacgctttccaacaggcttttaaactcatttaacgatgttttgtgaaatagcgaaaacagccaacggtttaaaatcaaatgttgggcaaaatgaaacttggcgtttttgggtgcttttgccattatgcgtccccctcaaacattaaggataagaacgcatcttcaatgctgacaatcttcaaactaccactttgctcgccgtcccacaccgtttcaagggtatggtcgccattgacatagacttgactgtatttgctatcagcagggttgatgcccaagcggtcgaactgtgcttgcaaaccgtcataatcgacacgttcacaatcacgccagaaaatcagtgttttttcgtccgcactttggttcggcagacggcactcaatcgccacaaaaccttgctcggcacgtttatcatccacattgataaccttcgccccaatcaggtaattaaaggtttctaccaaatccactttttgccattcataggcaccggcactggtggtgctaatgtttaagccataatcaaagggcttctcaaaatgcgaaatattgagcaaactaccccggctgtcgatattcagcatatagttcagcagataatcttgttgtgcattttcaggcaagtggtcaaataaatcactacggcgaagttcaaggttattcagcgtatcttcatagctttccagttttagcactttaacaatttgcggtacaccttgtagattttccgcaccatcttccgcaacgggcttaccgtctttccacgctttgctataaatcactttttgcacacgcggtttgagcaccgtatcaaaatattcgccttgttccacaaggatatattgacggctgcccttatcttcacggtttaggttaataacggcgtgggcggtggtgcctgaacctgcgaagtagtcgagaatgatttgatttttgtcatcaattaaagttactaatgttttaataaaagtaatattttttggagcattaaaaacatcatccttattaaataaatttttcaacaatgtcccagcagaagtggtcttaaaatctaattcgattgtagatttaatattttgagtgactccaacatattttttattagataagatgcttttcaatctgatagtcgtactaaaatttttttcatatattttattatccttgaattctaaagctttattttcaaataactttaagaattttctatctgtataagtgttttctacaaatgaatttccgatataagaaatatatcttacataaccttgagaaactaaattttcatctatttcatttaattgagtttctttttttgtgactaaatgttttaatgcatcatgataataaatagtatagtgtttatctgaattgaagttttggactaaattattaaacttattttcaccgaccaatactcgcttgccgctgttatgaacataattaccgtattcatcctgtgttaagtctttaatatcttttggtatattttcaataaaataactttttgtattatcaaaagcataaattagacaataatcattacatacagaaataaatttagagttttttctaccttttggattattttcaactgtcaatagggaaatgaagttttcttttccgaaaatttcattagaaagtaattttaaatttgcttgttcattatcatcaatgctttgaaaaataacacctgcttgattaagtaacggttttgctaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgctaatgaaaggcgattgtgaataagcgttgcccagcttgatttttgatacccatctttataaataaatccatctccccctgtattatacggcgggtcaatataaatacatttcacctgttcacgataacgggcttgcaataaatttaaggcttggaaattatctgaatgaataagagtgccgttgatatggctatcaaagtcgcccagtgagcgtgaaagttcggaaatcagtgcggattggaatgtggcagaaaagagtgatgtatctacaacaagatgttgtaaatcatcgtaaccatttgaatttaaaggcgttttaccccccccctgcattgtttgctttttgagcatttaaaaatgcttgagcacccgcagacggcaggttaaataggctttgccattgggcaagctgtttgacgttatgggcaatttcttcaataaatttgcccgcttgtttgagctgcaaaatatggttaagggtaattaaatagtgatgccctgccacaaatttctttttcagccacagttttttctggaaattttccaactgtgccaaaaaggcaataagctctaaagcaatgctacgtaaggtttgaattaggcgtaaattggcttcaagcggtgcgaaatggctaatgttttgcacatcgtccaaattcatcacttcgtttttaatataaaaatccaattcacggcgtaaaaaaccgcctaaatctttgtgaataaaataatcggcactgtttttttgtgtgtagtcacttaagtgtttttctaataaggtgcggttaggatttttttcggttggacaacgctcagctaaagcaatccacttggtttgtagcaaatcgtgtgcttgcaacgtggctaaatcttgctccaagattttctcttgttttgctgatttttcaaacggtttgtaatcaaacaaaatggttaaggttttgccgtcttcgctttggctaatcggctgaatttcaatgatttcggtttcgccatcttcattttcacgttcaatggtttgagccgtagccagagtaaataagcgtttggcatcgttgtctttgcgattgtctttggcaatatctgcactgtttaaacggaaaaatacggtgcgaccgtcatcaaggctaaaacggtaattgctgaaattctcgcccgatttggtgtaatactgatctttattcgcccaatggagcaacacttcttcgccagcatacggcacggcataagtgtcgcctttataacggcgttggctgataaaatcgccctcttcgtaataacggctaaaaaaggtgagtaaatggcgataaaccgccgtttcgtgatcggcactaccttttttggcttgttcgattttgttttgcagctcttggacttttggcgattgattggggtcaatgcctagctcttgggcttgttttttggcttgctccaattccgtctgccagcctgcgatttgctcactttggttattacccaacgcctgtttcactttttgtggcaaggtttgcgaaagatacttttcaatctcttggctacgcgtgtttaaaatccgataaatcccaaaatctaaatctgcacggttgatttggaagatttctttgagtttatgagtgagttcgataagttgggacataagaattccttcaattttaggtaaatttggggaattatagcaaagataacttgagtgttaaggctcttactccgcaaaaatttgcaaaaaataatagggttctgaccgcttgtgattttatttagtgcaatgataaattctaataatgtcaatttacgcaataacaaaaacagctataatcaaactcgcaaaaacaactacagtatgtaaacacaacatcaaacattcaacattaacaacacaggatttttattatggctaactatttcaacacattaaacttacgtgaaaaacttgaccaattaggtcgttgtcgttttatggatcgtagcgaatttgctgacggttgcaacttcttaaaaggcaaaaaaatcgtgatcgtaggttgtggtgcgcaaggtttaaaccaaggtttaaatatgcgtgattctggtttagatattgcttacgcattacgtgcagaagcgattgcagaaaaacgtgcttcattcacacgtgcaacagaaaatggttttaaagttggcacataccaagagttaatcccaactgcagatttagtgattaacttaaccccagataaacaacactcaaaagtggttgcagatgttatgccattaatgaaacaaggcgcagcatttggttattcacacggtttcaacattgttgaacaaggcgagcaaattcgtaaagacatcactgtggtgatgacagcaccaaaatgcccgggtacagaagtgcgtgaagaatataaacgtggtttcggtgtgccgacattaatcgctgttcaccctgaaaacgacccgaaaggcgaaggtatggcgattgcaaaagcgtgggcaagtgcgacaggtggcgaccgtgcgggcgtgttagaatcttcattcgtggcagaagtgaaatctgacttaatgggtgagcaaaccatcctttgcggtatgttacaagcaggttctatcgtgtgctacgacaaattagtggcagacggtaaagatccggcatatgcaagcaaattaattcaatacggttgggaaaccattactgaagcgttaaaacaaggcggtatcacattaatgatggatcgtctttctaactcagcaaaaatccgtgcctttgaattagcggaagaaattaaactccaattaaacgatctttacttaaaacatatggacgacatcatcagcggtgagttctcatcaacaatgatggcagactgggcaaacggcgatgcaaacttattaaaatggcgtgaagaaacaggcaaaacagctttcgaaaattcaccaaaagcagacggtatcaaaatttctgaacaagaatacttcgataacggcgtagtgatggttgcaatggtgaaagccggtgttgaaatgtcattcgatgcaatggttgcaagcggtatctatgaagagtctgcatactatgagtcattacacgagcttccgttaatcgcaaacactatcgcgcgtaaacgtttatacgaaatgaacgtggttatttcagacactgcggaatacggtaactacttattctcacacgttgcaacgccaattcttgcagagaaattaatcccaatgttacaaaaaggcgatttaggcgaaccaacaccaaccgttgaaatcgacaatgtgtacttgcgtgatattaacgatgccatccgcaaccacccggttgagttaatcggccaagaattgcgtggttatatgacagatatgaaacgcattgctgttggtgactaatttttagtgataaaaaagcctgctatggaaatagtgggctttttgtgtttggtttaattaatatgaggctttggtattctacaactagcccttacgttcgcaaagcaagagcagtagcgcattatcataacttgcaaaattaaattgaattaggggctgacgtagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaatacacccaatctttcaaacaaaaagtcatcgaattttattaaaacaaagcgacataactacaacaaaaaaagcaagataaataacaatttcgcttttttcacatacagcaataaaatttcattttttagagaaaagggctttaactattccactagctaaagcccttttagtcttttttacgtctttagtgacgttttcaatcaatcagaaaaccgttttttgacggtgcaagcaaacaatctgattgaaaggtaaaacctatttacttaatacaacctttaattaaataacctgcggactttccaacaaggaaaggggcgttaatatccgtgcaacgaataatttccactttaccgcctttctcttggtaagtatcaacaaataagccgtctttacgtcttaccgtgtaaccgtaagacggttcaaaaatattgccttttttgcctttatctttaccgtttgcaacataagccaaaacaatgctatttgaccagattttttctaaattgccatctttttcttgagaagctgcaccgatttttaccgtttcaacgccaatcaattcagcaaaaatttcaggggttaaaatgcctgtgcgagtgtatttgatacgttctaaaaggtttgtattttcttttaaaattttccaaacatctgaagcaattacacaaacattgggcaaacgcccaatagtagcagaaacagcttctaaaccatcattgatgaattttaaagggccagattttgcatttgtgaaacgttgtgtttcagtcagtgtaacaacattttcagctgaataattctctgcattttgtgcaatttcagcaacagccacttcacgccctaacgcaatgacatcttgaacaacagaaagagcgtattttttcaaaggatagctggcatcattatcttcacgataatcaatagggtattcaatatcgtgttcttttaattctacgcttaaacttgttacatcttcaggcgttaagcggttagagtcgccgtgtaattctcgaacggttgaacgagtgcgaaaagctaaacgcccaaactgtgggattttgcccgcttcttttgtaaggttatcaaatttaggaatatacaaatttaaacctccattaaatttcccaaataattctaaaaaatgaaacctaaactttgctttatcaccttgtgccttttcgtaagcttgttcaatacaactgtctaaagtttcgattaaattattgtaagcaacttcagcattgttcatatatcgctctgttttaatcattcaaccaataccgcaaactttaaactgatttataaaactgctcttttaaactactttaataaaacacttatactgcaatacataactaatgccaaatacaacaagcaagaatcaaatttaaggcgtttacgagcgtttataaacacactaaaagacaaaagagctacacttgttcggcttaaacagaaaaagggcttaaaagggcgtttttgtggggattggtaaaatttaggggaaatttgaccgcttgcaagaaaagatttgaatggttcaacttaatgaaagaaattctattttataaaaatcaaatagttatgagtaaacaacaatgattttaaagttgaacattcaattttttaattaaacacttgctatttatcttaaaacgcgtatgactgttctcaaggtgtcgtaaccttacacaaagcggataaccgcacccgatagatcaagcggttttttgtacctaaaatttgcaattttggggcaaaaggcacaatttatttaaactcaataccgagggggcgaggaatacaacacccgaaagggaaataactccagccgtctttgtgtggcttacgaaccccttggcaccctattttatagggtaaaatttcgtaaatacacaaaggagttcattatgaacgctcaacagttccccttttctcttcaaacaaaacttatcaataatcgccaacaatcttttatttcattaaaagagcttgcacacgttgcttttagctggcatccaaccaccaaagaaagccaacaacatttaactaaattaggctttcaggctgaacaagattatttgattattcaaaataaagcacggaatgaaacgcttgatttttggctttccattgaaaccgccattagctttatagataaaacaacagactgctggacaccaattatcaagcgttgcttagaagccttgggcgaattacgcaaaatgaataaatcagccgtaaacgagctacggccagcgataaaccaacaacgttttattgtagaaaccaatgcttttttaaatacttattttcaatatgaccatcattttttaattagtgaagatgattttgttgcacttgaacgaatgaaaggggcttgcaccgcttttgagcaaatgctacttgaagtgaataataaccgttcattaagctatgaagccttagccgatttattttcttgttgtaccgctcctctatttgacgtgctgaaacgtataaaagacgtaggcgatgaaaccaatacaattaaagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatcttaaccaaacaacaatttcccccagcgaatacaacaaatcattgctagcgatgccgcataatttcttgctaacttatcgtaccgagtcgcaatggctcggtattgttttaaaaaagcaaacgcattttcaactaaatggcgataacgatataaacaccagtctatatcatcattacccacctttgaatttcgtctacgaggtataaccggaactgcttttgttgtcaaaataagcactcgtaaggcttcacaatcataacctctgtctgcaacaatggtctcactgtcaggtaacaattccacaagctcagacgcagctttactgtcgtgaacttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctagacattttgaataaattaagagcatacaagaaaattttttaaaaaagtgctagacaagcgagagtgaaatcactaatatacgcctccgttgcgacgcagtactgaaaacaacgcgttcgtagctcagttggatagagcgttggcctccggagccaaaggtcgcaggttcaaatcctgtcgagcgcgccagaggtaatgcaatatcgactagaaatggtggctatagctcagttggtagagccctggattgtgattccagttgtcgtgggttcgagtcccattagccaccccattaaatatatgcagtggcatatcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccataagatgagcccaagtgggattaggtagttggtggggtaaaggcctaccaagccgacgatctctagctggtctgagaggatgaccagccacactggaactgagacacggtccagactcctacgggaggcagcagtggggaatattgcacaatggggggaaccctgatgcagccatgccgcgtggatgaagaaggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctccccgaaatctatttaggtagagccttatgtgaataccttcgggggtagagcactgtttcggctaggggtccatcccggattaccaacccgatgcaaactgcgaataccgaagagtaatgcataggagacacacagtgggtgctaacgtccatcgtggagagggaaacaacccagaccgccagctaaggtcccaaagtctatattaagtgggaaacgaagtgggaaggcttagacagctaggatgttggcttagaagcagccaccatttaaagaaagcgtaatagctcactagtcgagtcggcctgcgcggaagatgtaacggggctaaaatatagcaccgaagctgcggcatcaggcgtatcacaaatacgccttcgattaacaacatcgaatgaagtgaaacggaataagatgttggtcaagcacccaacacgttgagttggcataaagtgcggatagaaatcagaggaatatttgtgatacgcctgttgggtaggggagcgttgtgtaagcggatgaaggtgaatcgagaggtttgctggacgtatcacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgtctccacccgagactcagtgaaattgaaatcgccgtgaagatgcggtgtacccgcggctagacggaaagaccccgtgaacctttactatagcttgacactgaacattgaattttgatgtgtaggataggtgggagcctaagaagcagtcacgccagtgattgtggaggcgtccttgaaataccaccctttaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaacactctcatttttgtataattttaattaaaaagtttaaaaaatgttacaaaataaatttttttgttctatacttgaacaaatttaagatgtaggacaaatagtagtcagttgattaaaaggaaaagttaagatgctgtgatttctgctatattggacagtttagaattttgtattactagggagaaaccttatgtttggctttgatccgacaacaacgacgtttctgatttatattatcggaatggtcttaattggttttgttgcttatcgatttacgaataatttatcggactatattttaggcggtcgtcgattaggtagttttgtaacagggttatcagcaggggcatcagatatgtctggctggttattaatgggtttacctggtgcggtttatgcggcaggtttggttgagggctggattgcaattggcttgaccataggtgcttaccttaactggttatttgtagctggtcgtttgcgtatgcatacggaatacaatacgaatgctttaactttgcctgactatttccatcaccgttttggcgataacacaaaaatcctcaaaattgtgtctgctactattattctatttttctttgccatttactgtgcttcgggcgtagtcgcaggggcaagattatttgaaaatttatttggcgtgccgtatgccacagcgttatggtatggtgcattagccactatcatctatacctttattggtggtttcttagcggtaagctggacggatactattcaagctagtctgatgttatttgctcttttcttaacccctatttttgtgttaattcatttaggtggctttgcggatacgcataatgtgattattgctgcagggcaatatgtcggtaaggattttactgatatattcacaggcacaacctttgtcggtctattaagtttagctgcttggggattgggttattttggtcagccacatattttagctcgttttatggctgcagatagtgtgaaatcaatgccaaatgctcgtcgtattagtatgacttggatgattatctgtttatttggggcggtagggatcggcttctttgggcaagcctacttcttcgcaaatcctgaacaggcggctgtggttaatcaaaataatgaacaagtctttattgaattatctaaattactctttaatccttggattgttgggattttattatcagcaattttagcagcggtaatgagtacattaagttgtcagttgttgatctgttcaagtgcgattacagaagatttctataaaggtatgattagaccaaatgcaagtcaaaaagagctagtttggttaggtcgtatgatggttctcgtgatttcagtgattgccattgccattgctcaagatccaacaagccaagtattaaaattagttgaaaatgcgtgggcaggttttggctgtgcttttggacctgtggttattctttcgcttttctggaagcgaatgaatgcggctggtgcaatggctggaatgttagtcggggctttagtggtggtattttgggataaattattacctgagagtgctgtctacgaaatgatccccggctttatccttgcctttatcgcaatcatcgtggtttctttgattacccctgcccctaaagcagaaatcgtggaaacgtttgataaagctgaaaaagcctatgcagatgcaatgaaataatttatctagaaacggtttgccatttggcaagccgttttttgcttttaacaagcggtgagattgcagtgatattttgcaatcatctcaataacaacaatgaaacgggagaaaaacaatgtcagccacatctcattatcatattttgcctcaaggtaccgctattcgcccaacgttaagtgaacactatcgttgtgatgaagagcaactcgtcaaacaacttattccgcaagctagagtagatgaacacgccgaaggcattaaaacgcttactaaaaaactcgttgaaaaagtcagaaatgctcgtcagaaagccagtggtgttgatgcgttgatgcacgaattttccctatctagtgaagagggtgtggcattgatgtgtcttgctgaggcgttattgcgtattccggacaaagcgacagccgataaattaatccgtgacaaaattgccaaaggggattggcgttcccacgttggcaatagcccttctctatttgtcaatgcggcagcgtgggggttagttgttacgggtaaactggtagctacccacagtgaaagtagtctggcttcttcgctttctcgccttattcaaaaaggcggagaaccgcttattcgtaaaggggttgatgtggcaatgcgtttgttaggcaaacaatttgtgacaggggaaaccattcagcaggcgattaaaaatggcgagaagcggttcgcaatggggtatcgttatagctacgatatgttaggtgaggcggcattcacagaacaagatgctaaacgctattatgatgattatgttgcttctattcacgctgtgggggcggtttctcgcggtctaggggtgtataaatcttccggggtatcggttaagctctcggctattcaccctcgctatagtttagctcaacacaagcgggtaattgatgaactttatccacgtttgaaagatctgtttttattagctaaacagtacgacatcggtttgaacattgatgcggaagaagcggatcgtctagagctttctttggatttgatggaccgcttgattgccgatcctgatttagctgactttgctggtatcggttttgtggttcaggcgtatcaaaaacgttgtccttatgtgattgattatttgattgagaaagcccgtgcgaaccaccgtaaattgatgatccgcttagtgaaaggggcttattgggacagcgaagtaaaacgcgctcaagctgatggtgcagaaggttatcccgtattttctcgtaaagtccatacagacttaaactatgttgtttgtgcgaaaaaattattgtcggcacaagatgtgatttatccgcaatttgctacccataacgctcaaaccctttcaaccatttaccatttagcacagggtaaacattttgagttccagtgcttacacggaatgggggaaactttgtatgatgaagttgttggctcacataatctcaatgttcaatgccgaatttatgcccctgtaggttcttatcaaacgctcttagcatatttggttcgtcgtttattagaaaacggggcgaacagctcttttgttaatcagattgtcgatgaaaatctcagtattgatgatttagcttgcgatcctgtcgcaaaagcccaaataaccgaaggcacaatgcacccgaaaattccattgccagttaaactttttgcggaacaacgtcaaaattctaaaggctatgatttaaccgatgcgatccacttaaaaacattagaagcggaattaaatcaacttgcaagccgacaatatcgtgccgagccacaaattgcaggcgaaaaaactgaaaatcttcattctcgccaagttcacaaccctgcaaatatcgcagaagtggtcggtgaggtgattgaggcaacagaaaatgatgtggcaaaagcctttgcagttgcggaacagtttaaagctgagtggcaaaacacgtcccctatagttcgagccgaagcacttgaaaaaatggcagatttgatggaagcaaatatgcctcagctctttgatttagccgtacgagaagctggcaaaaccttaaataatgcgattgccgaagtgcgagaagcggtcgatttttgccgttattatgcaaaagaagttcgtcaaaaccctgaaggttatcgcaatccgagaggaattgttgttgctattagtccgtggaacttcccgcttgcaatttttgtgggcgaagtctcctcggccttagtggctggtaatgtggtattagctaaacctgcagagcaaacctccttaatggcatattatgccgtgagtttatttcatcaagcaggtatccctgagcaagccttacaatgtttaaccggtagcggaaaagtgatcggctctgccttagtgagcgatccacgagtaaatggcgtgattttcacaggttcaacggataccgctaaaaacatcaatcgcaatttgcaaaaatcagcccatatcgtaccgcttatcgctgaaacaggcggacaaaatgcgatgattgtcgatagttctgcgttaggtgaacaagtggttgctgatattttaaactcagcctttgattcggcaggacaacgttgttctgcattgcgagtgctttatttgcaacgtgatgtcgcagagcatatcctgacaatgctcaaaggggcaatggcagagttaaaagtcggcagaccgcaaaatcttaatacagacgttggtcctgtgattgataaagtcgcccaagagcgtctgcttaatcatatcgacgaaatgaaaaaagtggcgaaatcgtgctatcaagttccgattgatcctgaactgtctcaaactggcatttttgtaccgccgacgctactcgaaattgagcatatcaatcaattaaaacacgaggtatttggccctgtgctacacgttatccgatttgatgcagataatctaccgcaagtgatggcagacattaactcgacaggctttggcttaaccagtggcttacatagccgtattgatgaaaccgtggatttatggcttgaaagtatttacgcaggcaatctctatgttaatcgaaataccgtaggggcagtcgtcggggttcagccatttggcggaatgggattatctggcacagggccaaaagccggtgggccactttacctacaacgcttagttaatcgctgtgaatggacattatcgggtttagaagggggcaaaccagccgacacttcaggcttactcacaggcatacaagcggtgctttcaggcacagaattacaaaatgcccaagatcttattgcaagtctttctcgccagtcgccgttagggaaagtctttaaaatgcaagggattacaggggaagtaaactttatgcaatttgaagctcgcccagttattgcaatcggtaatggctcactagagcaacaaattcaagccttgattgccgtagtggtgtcgggtagccgtgctgtggtacattctaattcgccactggctaaacaggctcagcattttgcaggcttagtgattattagcaatgatttcaatagcttagcaaatttaagtagcttgattgtgcttgaaccgctttcattagaagaaaaagctcactatgcagaacgcacaggggcaattctcacctatgtggaaaatcttgaccttgctctttcattattcccattactacacgaaaaagcgatcagcattaataccgctgccgctggtggaaatgcgagtttgatgagtgagatggattaattttaagataattggataagggctgagggaactcagctcctacaaaatgaatattatgcaatagttcatcatatcaagtttttgtaaaaaataaccaaatccaaccacttgcaaccactatatcttgtgtttctaatttttaaaaacacaagatatagtttttgagcgaaactgaatttttacaaaaaatttttccttttaaaatcaatcactaggacgacacaatcagggatagccatttgtcaagatcttgtagaacgaaaaaatatctctaaaatactccccattgaataatcaaccacgaagctcaaatcattatggcacgcaacatttttgaaaaacgcattcaaatcaaaccttatgaataccccgaattacttgagtttaaagatgcaattcgtcactcgtactggttgcataccgaatttaattttacgggggatattcaagattaccgtactaatattaatgaccacgaacgccacgttttaacccgtgcaatgttggcaatttcacaggtggaagtgaacgttaaacgtttctggggtgagctatatcattatttcccaaaaccagagatggacgatgtgggggggacttttgcggaaagtgaggttcgccataaagatgcttactctttcttgttagaaaaattaggcttaaacgatatgtttacgcaaatcacggaaattgagccgttgatgaaacgtattcgttatatggaagattttatgcgtgagaaggatacaggcaaagggcagtttgtgctatctcttgtgttgttctcgttgttcgttgagcatatttcgttgtttggtcagttcattattatgatgtctttcaataagcataaaaatctgtttaaagggatttctaatgcggtggaagcgacttcaaaagaagaagaaattcacgggcgttttggtattgcgttatatgaaattttgagtgatgagcatagtgaattatttacccctgagttttttgaagaactcaaaactttatctcaacaagcctttgaagctgagagaggcattttagactggatttttgaagagggtgatttaagttttatttctcgtaaaaccgtcgaaaactatattatgaatcgctataacaattcattatctattttggggttagaaccaccatacgatgtagatcctgagttgttaaaagaaacagagtggtttgatattgaaattatttcaactaaagaaacagatttctttaacaaacgtagtaccgattatagtaaaaaaatgaaacagattactgccgatgacttattctaatgattattatcagccaaagttattccaacttggctacactaacgtaaaccgtcctgattttgagtggttgaatgacgatagccgtcttttcttgcaacgtggctatttgttggaaggaacaactgctttagatcgtattcgttttattgcagaacacgcagagcgtaagctaggtattgaaggctatgcggataagttctactactatatgggacgtggctatttctcgctctcttcgccgatttggtcaaacttcggtttagatcgtggcttgccgatttcgtgttttggtagctatattggcgattcgatccacgaaattatggtgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccgctgaagtgggtatgatgagtaaaatcggtggcggtacgtcagcctattttggtgatattcgtccgcgtggtagtttgattaaaaataacggaaaatcagacggttcatttaactttagtaagttgtttgatacggtgatcgatgttatttcacaaggtacttctcgtaaaggacaattcgcaggctacattgatattgaacacggcgacattgatgagtggttggatattcataccgaaggtaatccaattcagttaatgtactatggcgtatgtgttggacacgactggcttgagtcaatgaaagcaggtgatccatacaagcgacaactttgggcgaaaattttgcaacgtaaaacagaaacgggcattccatatctgttcttcaaagacaatgcaaatgcaggtcgtcctgatgtgtataaagataaaaatatgacggttcacgcctcgaatttgtgtaccgaaattatgttaccgtcaaataatgaagagagtttcgtttgttgcttatcttcaatgaacttgctttattttgatgagtggaaagatactgatgctcctgaagtattaacctacttcttagatgtagtaatgtcggaatttattgagaaaagtgctgaaattccattccttgaccgtgcaaatcgttttgctaaacgtcaccgtgcattaggaattggtgtgttaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagaaaagacaatgaaggcttcagaagaacttgctcaacgctttggtgaacctgaattgttaaaaggctatggtcgtcgtaataccaccttaatgagtattgctccgacaaaatcaagtagctttattttaggcagtgtatcgccgtcggttgaaccgtttaaatcaaactactatgttaaagacttagcgaagattaaaacggtttataaaaacccattcttagagcaacttctcagagaaaaagggttagataccgaagaaatttgggaaagtatcttattgaacgatggctctgttcagcatttaacacagctctctgaacacgaaaaagaggtctttaaaactttctctgaaatcagtcagttaagcgttattcagcaagcggcacagcgtcaaaaatacattgaccaagggcaaagtattaacattatggttcaccctgctacccctgctcgtgatttaaaccaactgtacttaacggcagaagaattgggcttaaaatcaatttactaccaatactcaatgagtgcggcacaagtgtttaaccgcaacttgttaagttgtagtagctgtgaggcatagtctcttgttagaaaagcgatcttcgggtcgctttttttatttcatttgataacttttgatagaaaaatcgccataaaatcgctatacttcaccgcttttcagcaagaggaatttgcaaacaagcgggtgtttaactgctgatatttgcaaaggaattagttatctttttcattaagaggatttgaagattggttaaatttgctcaatcatttttgaataaacttgctgtcgcaggtgttgcatttttggcactcactgcgcaggcagccgaaaaattgtatgtgtataactggacagaatatgttccatcttctttactagaacaatttaccaaagaaacgggaattgaggtgatctactccacctttgaaagtaacgaagaaatgtactcaaagttaaaattaacgaatgggtcgggttatgacattgttttcccgtcaagctattatgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacgaatgggtcgggttatgacattgttttcccgtcaagctattatgttggaaaaatggcaaaagatggaatgttagcagaaattgataaaagcaaattaagcaatttccacaacgtaagcaaagccttaatgggtaaagagtttgaccctgaaaacaaatactcacttccttatgtctatggcttaacgggtattggtgtgaatgcgtcagacattgacccaaacacgattacaagctggggcgacttatggaaaccagaattcaaaggcaaggtattgctgatgaatgactctcgtgaagtgtttcatatagcattattgttggacggtaaatcaccgaacaccactaatgctgatgaaattaaaacagcttacgagcgtttaacaaaacttgtgccaaatgtacttgtatttaactcggattctcctgaaatgccttatttacaaggcgaagttgcgattggaatgcaatggacaggttcggcatatagagcgaagagtgaaaatccagacttaaaatttatcttcccaaaagaaggggcggtaatttggatggataattacgtcattcctaaaaatgcaaaaaataaggaagcagcacataaatttattgatttcttgctgcgtcctgaaagtgcaaaaatggtaattgaaacgatgggtttctcaatgcctaacgaaaatgtgaaggcattattacctgcagaaacagtgcaagatccactgattttcccaccgcttgcagaaattgaaaaaggtgttttacaaagtgatgtcggcgatgccgttgaaacttatgaaaaatactggaatttacttagaacaaaacgttaattagaggttaaaaaatgtctgctcataatacagcaacagcaaattctggtccacttggtttatgtggtttcgcattaacaacgtggctattaagtttaatcaacaacggtactttcggtggcgaaaatgtaggcttagtgcttgcaatgggctttgctttcggcggtactgcacaaatgattgcaggtatgtttgaatattcaaaaggtaacacttttggtttcactgcatttatcagctatggtgcattctggtggtcatttgcattattaaaagtgttcttcggtgcaaccgtatcacctgaatttatcggttggtacttagtcgtttggggtacatttactttaatgatgttcttcggcaccttaacaaaaccgcgtgcgttacaagcgattttccttgcgcttaccatcacattctacctattagcagcaggtgatttcactcacaatgcaactattactcacattggtggtaacttcggcttattaactgcgttattagcattctatttagcagctgctgaaattcttaacgaaagttttggacgcactgtgttgccaatcggcgcaccgaaataattttgcggtaaattagagaatctgtggtttagggtgtgtttaggagtacggaacacagcctttttgatctcagttttcctttcagaatggttatctatcgggaaatttattttatttgtgtattaaaaaataaaatactgtgatcttattttctattattctaattgctctattacttaatggataaacaaaaatgattggaagactttgtggtaggattattgaaaaatctcctccatcaatggtacttgatgttcaaggagtgggttatgaagtattgatgccaatgactagtttctataatctacctgatcttaatgaagataccatgattttcactcatctggtaatccgagaagatgcgcaccttttatttggatttgttcagaagcaagagcgtatgctatttcgtgaactaattaaaacaaacggtgtagggcctaagttagcattagctattttgtcagcaatgtcagtttctgaatttatgtctgctatagaacaggaagaattagcaaaacttatcaaaataccagggattggacgtaaaacggcagagcgtttgttggttgaattgaaaggaaaattttcaactttatttcatcatgaaatttctattttacaaccatcaggaaatcttttatcaatggcgtctatgagcccagtaaatgaagcgattgatgctttgatttcattaggatataaggcagcagatgctgaaaaaatggttaaaaaagtaaacaggaaatctgaatcaacaagtgagcaacttattcgagaggctttaaaaaatgctttgtagctatattgattgccctgagatattaggtatagtagacaaaacagttcagaaaaaatttgtctactatacctaaaagtcgacatttatgattcagatggaacgttttcttaagtagcaatgttcacttgaccttcaacaccaatatctctttgcattttttgcaaatataagaccgcttgtgttgcataatagcgttatgacggcggattgataaaaaatgcgtttggcaaccgcaacggtaggggaattgttgtcccgcaacattggttacatcaaagcaatggtacgtttcggcaggcacgccgagaacctctttcatcatcattttccactctttgccgtgtggctgtacttgtccgaattgttgataaaccagcaggtgagcaagttcgtgtgggacaacttgttgcacgaagtttgagctattttcactcaataaaatagggtttaagcgaatttcattttgttgcaagtaagccacgccagcttttcgccctcgcactgtgtaacttatcgttgggggcgtaaagtgtttgttaaaatagcggtttgccttgtccaaatctcgttttaactggcgttggacttgcattttgagttcacgaagatgttgcactagcgagggcaatccattacgttccagctcttgtcgtaacaaatataaagttcgttgcgactggctccaagataagcctctttaagctgtgggttaaatttttttaaccacgcaaatagttctttgcgtgagagttcttgtcctggtaggttgaggctacggaaaagttgtttctgtttctcaaaatagtcttctgcattattgaacgcacaggctccgtgtttttcccattgtccttgtaacaaacttgcccctggggactctggtagatattgtttaatcagattttcaggtagttgagccaaatcgccttggcagaaacgtgggtgttcatcagctgatcttgccgttgccgattgtggccataaaccgtgaataacccaaccaaatttcgaggcttggttgcattgcaatgcaagatgagctggaacgtttccgttatttttgcttctctgttcttcgcaaaaacttggcgaccacgaaagtgctaacatatagtaatccacagaggcttggcggttttgcccaaacttatcttttgccatattggtatcgtaattgcctaactggcttgggatttcaacattgttggtgcttagtgaaaccgttggtgctggcgttggttgcttacgttcttgttctttcttttcattgttaaaccaagtaatgacggaaaaaataccgatcaccacaagggaaatgagctgagtaagcgtgcgtttttgagtggattgctgttttttcattggtcaatctaagcgttagaaataaagggttactataccatttgcgtcagtggttgcaaaattccctgagaaaatctccgcttgttatttcttttagttatattaaatgccattcttatccttaacattaggctaaaaatccgtatgctaaccacattcaaactagcacgaggaacataacaatgacaatttatgcagacaactcacaaacgataggaaataccccgattgttcgtttaaagaatttcggtcacaacgggaatttattggttaaagtagaagctcgtaacccaagttttagtgttaaatgccgaattggtgcaaatatggtatggcaggcagaaaaagatggtatcttgacgaaagataaggaaattgtcgatgccaccagtggtaacactggcattgcgctagcctatgtagcggctgctcgtggttataaattgacattaacaatgcctgaaacaatgagtattgagcgtcgtcgattgctgcgtggcttaggggcaaatttggtgctaaccgaaggggcaaaaggaatgaagggggcgattgccaaagctgaagaaattattgcgagtgatccgaaccgttatattatgcttaaacagtttgaaaatccagcaaacccagctattcaccagcagacgacaggtcctgaaatttgggaagcaacagaaggcaatattgatgcctttgtcgcaggtgttggtacgggcggtacgatcacgggagtaagccgttatatcaagcaagataaaggtaaacaaatcatcagcgtagcggttgagccagccgagtcgccagtgattacacaaacgttaaacggagaagaaatcaaaccaggtccacacaaaattcaaggcattggtgcaggctttattccgaaaaacttggatttaagtttgatcgaccgtgttgagcaagtggatagcgaaaccgccattgcaaccgctcgtcgtttgttagccgaagaaggtattttggtcgggatttcatctggtgcagctgtcgctgccgcagatcgtttagcaaaattacctgaatttgcggataagacaattgtggccattttaccttccgcctcagaacgttatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtaccttgttgtttgagggaattgaaagttaatgtacaaaatatcgtgtagcaatgtatattctcatattgctatacgatctaaaaatagtcactttaatttaccttgaatgatcttatttgcacaccaagcaccccaagagtggcaaaatagctgattgcagcaagtacaattaaccacgcaagccaatggactttcgcccaaaaattcaatgtgttccaacctgttaaatccggagaaaaataggacactaacgcccccattacacaggcagcaatcagcagtttaagggtaaaaattgccgtggttgttgtgactttataaatgcccttttgagctaagccacgataaagtaagccagcatttaccgcagcggaaagtgccgaagccattgctagtccaataaaaccgaaaggaatagccagtacaccaaaacagatattacttaccgctgcaatcataccgattttgactggtgttttggtgttttggttagcataaaagccgttcgccaaaatactaattaacatatagctaattaagccaaagcacatcacaaacagagcttgcgaagaagcgataacatcattgagttgaaacttcccgtgcataaacattgtcatcatcaacggttgagcaaggatcatcattccaaccatcgcaggaataccaagcagtaataccatacgaacaccccagtccattgtttgctcaaagttaaatttacgttgttcttccgtcaaatctttctgtttggcaatacgagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgtgataagccacctaaaaataccccccaggcaagtgccgtatcgggcgaggcaaagaaatcttttccccaaattgcaacgcaaataattgccacatttaacagaacaggggaaaacgccattacaccaaatttacctaacgaatttaaaatcgcccccgataatgcaacaaaagtgataaaccacaaataaggaaatgtaattttgagtaacaacgaggcttgggtaaatttttctgcatcaggtccatcattgagccaatctaaaaaccaccccgtaccaaataatgcggcaatcacaggagatgcaatcattgcgactaaggtaacaacagtcactaatccacctaaagtccctgatacttttgcaataaattcacgagttttgtctggatcattatcggcattatattccgccaaaacaggcacaaaggctttagaaaacgccccttcggcaaataaacggcgaagaaagttaggaatgcggttggcaaataaaaacacatcggcagcaacgcttgcccccagtaagttagcaaccaccacatcacgtactaaaccaagaatacgagaaagtagggtcataccgctgacaatcattcctgatcgtaataatttcttgctcacaatttgttctctttatcttcttaaaaaattgatcggaattttagcagtttgttataggaaaatcagaaaaaaactgctaaaatccgcctctgtcttttactcaagaacatttcttgtgtgaaacgatgttattttcaagcccgtgtctcgttgaaaatgaatttaaactatcgatagcactgcataaaaaattgttttttatgtttttatttttacacagatatttttaggagtttgaccttggctaatatcaagtcagcacaaaaacgtgcggttcaatcagaaaaacgccgccaacataacgcaagccaacgttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaacgttcaatgatgcgtaccttcatcaaaaaagtatacgccgcagtagcaactggtgataaagcagcttcagaagcagctttcgttgaaatgcaaaaagttgtggatcgtatggcatctaaaggcttaatccacgctaacaaagcagctaaccacaaatctaagttagctgctcaaatcaaaaaattagcgtaattgcttttttaaacaaatttgcaaattttttggaaaaccgaccgcttggtcggtttttttgatttgcataaaaatgctttcctacagcttatctatttgagaatagtaagcatcgtatcaaatctcataaaatttaatgtgtaaaagctaattctaataagcatagaaatagaataagagaatttatttgatactcaacgtaataaatattatttgtgatagaatctatttcaaattatctctatttttcttacatatgagcgttaaaggatctaaaccccttattcaaatcctccctccccaactcgccaaccaaattgccgctggcgaagtggtggaacgtcctgcgtcggtggttaaagagctggtggaaaacagcttggacgcaggggcaacgcaaattcagatcgatattgagaaaggcggatcgcagttgatccgtattcgagataacggctgtgggatcggcaagcaagatctcgctttggctttggctcgtcacgccaccagcaaaattgctacccttgaagatctggagagtattttaagtctgggctttcgtggtgaagccttagccagtatcagctcggtgtcccgtttaacgctcacttctcgccccgaatatcaggcagaagcgtggcaagcctatgcacaagggcgtgaaatggaggttgaaatcaagcctgcttctcaccctgtcggcacgactattgaagtggctaacttgtttttcaatacccctgctcgccgtaaattcttgcgtaccgataaaacggagtttgcccatattgatgaagtggttcgccgtattgcattagcaaaaccgaatgtgacttttacgctaacccataatgagaaaaaagtgcgttactataaagcggtggcgacacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcttgaacagcaacaaaaacgggttgcaacgatttgcggtgatgagtttattcagcagtcggtacacattgattggcaacacgacgatctacatatttacggctgggtcggctcaccaagtttagcgagagtgcaaaacgatctctgttacagctacgtcaatgggcgaatgatgcgagataaaacgatcaaccatgctattcgtcaagcctatggggaacggttgccgaaggatcattaccctgcctttgtgctatttttagatcttgacccaagccacgttgatgttaatgttcaccctgcaaaacacgaggtgcgttttcaccaaagtcgcttagtccacgatttcatctaccaaggtgttttgaatgctcttgaagatcaacatcatttacctctgacaacgaatgtcagcgagaccttgccgaattatattgccgacaccaaccgtgtggcttcggggcagaatattttcgctcacagttatcgtgaaccacgcttgacttcatcaactcacgcagaacgcccaaattacagcaatactcgctcatcaggggtaagcaaaagcgaacagaagtggtatggcgaattgctttctacatcgcctatgcaagactataagcggtcagaacctgttcaagatttgtcaaaaacagccaagatcacaccgcttgttgaaccgatagccgagccggtcacgccctatgctcaagccttagcggtagtgaaacagaaagcattgttgatgaaacagggcgaaaccttttatctgctttcccttgaaaaattggctcaattaaaactacaagctgagttagccaaaagggaaaatcaagctctgttgataccgctaagtttaacccttgatgaacagcaaacagcgtcttggcaacaatcgcaaaccgctttggcagacttgggttttgatattcaaacaaaacagtggcaaggacaaactcgccttaccattcaaaaagtcccaacttgtttacgcgaacaaaatctgcaacaactgctgtttagtctattcaatcaacaagcggtcgattgtgccgaattttttgcaaaaaatgcgacttatccaaccgctagcggtttgagtgaagcggtagcgttattggcggaggttgaagtgctgccgagggggaaagcgatgttagaggcgttgagagttgaagtggattttgaagaaatactaataaatctttaagaaaaaatctctatctattccatctatacccataaggtatattgaatgattttcgagcttgggtgtataagttgccatgaaaaattttcataatgtttgtgaaaattatgaacttgcataatgttgttgttttgtagattatataactagccatttagacggctaaacgtctaaataaaagaaatatcaaatctatcaaaggagaacacattatgacaacattccacatcttaggctttccacgtgttggggcgaaacgtgaattaaaatttgcacaagaacgttactggcgtggggaaattgcagaacaagatttattagatttagccaaagccttgcgtgagaaaaactggcggcaccaagcggctgcaaatgctgattttgtggcggtgggcgatttcaccttttacgatcatattttagatctgcaagtggcaacaggggcaattcctgcgcgttttgggtttgacagccaaaatttaaccctttcgcaatacttccaactggcgcgcggtaacaaagatcaatttgccattgagatgaccaaatggtttgataccaactaccactatcttgtgcctgagttccacaaaaacaccgaatttaaagccaaccctgctcactacgttaatcaaatccgtgaagtgaaagccttaggcttgaaggttaaacctgtgattgtcgggcctttaactttcctttggttaggcaaagagaaaggcgaagcctttaatcgttttgagttattaaacaaacttgtgcctgtttaccgtgaaattttaaccgcacttgcagcggaaggcgtggaatggatccaaattgacgagccggctttagccttagatttaccggcacaatggttggcagcttatcaagcggtctatgcggaattaagccaagtgaatgcgaaattgttattagccacctattttggctcagtggcagaacacgcagaattgctcaaaggcttagcggtggacggcttgcatttggatttagtacgcgcgcctgaacaacttacggcatttgaagattaccgcaaagtgctttcggcaggcgtgattgatgggcgtaacatttggcgtgcgaacttaaatcaagtgttagatctgcttgagccgttaaaggcgaaattaggcgagcgtttatggattgccccaagctgctcattgttgcatacaccttttgatttagcggtggaaacgcaattacaagcgaataaacctgaactatatcaatggcttgcctttacgctacaaaaagtcgaagaattgtcggtaattaagaccgtacttgaacaaggtcgtgtagctgtacaagcacaattagcggcaagccaaacggcagctaatgcccgagcgacatcaaaagagatccaccgtgcagaagtagcggctcgtttagccaacttacctgaaggggcggatcgccgtcaatcgccatttgcagaacgtattgcgaagcaaaatgcgtggctaaacttaccgcttttaccaacgacaaatatcggttcattcccacaaaccagcgaaatccgccacgctcgtgcgagctttaagaaaggcgatttaagccttgcggattacgaaacggcgatgaaaaaagagattgaatatgtggttcgccgccaagaagagttagacttagatgtgctggttcacggcgaagcggaacgtaatgatatggtggaatatttcggcgaattgcttgacggctttgcctttaccaaattcggctgggtgcaaagttacggctcacgctgtgtcaaaccgcctgtgatttatggcgatgtagctcgtcctgaaccgatgacggtgcgttggtcgcaatatgctcaaagcctcaccaacaaagtgatgaaaggaatgctgacaggacctgtgacgattttacaatggtcgttcgtgcgtaacgatattccacgctcaacggtctgcaaacagatcggcgtggcattgtcggacgaagtgttggatttagaagcggcagggatcaaagtgatccaaattgatgaaccagcaatccgtgaaggcttaccactcaagcggtcagattgggatgcttatttgcaatgggcgggtgaagccttccgtttaagctatatgggcgtgcaagatgacacccaaatccacacccatatgtgttattccgagttcaacgacattttacccgcgattgccggcttagatgcggacgtgattaccatcgaaacctcacgctccgatatggaattactcaccgcctttgccgacttcaaatacccgaacgacatcggaccgggcgtatacgacatccacagcccacgcgtacccaaagcggaagagatcgaacacctgctgcgtaaagccttgaaagtggtgccgaaagaacgcttatgggtaaacccagactgcggcttaaaaacccgtggctggaaagaaaccattgagcagttgcaagtgatggtggacgtgacgaagaaattgagggcggagttggtgtagttaatatttatcttaagctatggaaatagtatagatatctttgtcaacaatctgaaattagccctattacttgggctaatttcggatgtattccttgtaatgtacattgcatctgaatatatcttccaaaataacaataaatttgtcctattctttaccataaaattttctgtattttatttactgtgtataaaaacagtgatactatatactcatacagtgcttcgtatgggtattttcttatgctaactcaattaaccatcaataattttgcaattgttcgtcacctaacccttgaattaaatgaaggaatgtctgtaattacaggggaaacaggggctggtaagtctatcgggattgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcttggcttatgcttaggctatcgttctgaaagttcgatgatccgtaatggtgcagataaagcggatatttcggcgacattttctatgcaacctactagccctgcctatttatggttaaaggaacacgagctactcgatgaagataatccacaagagtgcattttacgccgtatgattaaccaagaagggcgttccaaagcctttgtcaataatcacccaatccctgtttcacaactgcgagagcttgggcaatatcttattcatttgaatggtcagcacgctccacagctcttactgaaaagtgagtatcagcttgaagtggtggataattatgccaatttacacccattattagcggaaatggcaacgcaatatcatagttggcgaaaattgcataaacaggtgaaaaatttccatcaacaatgccaagagaatgaagcacgcaaacagcttttgcaatatcaagtggaagaacttgatgaatttgcgattaaagaaggggaatttgagcaactagaagaagatcacgctcgccttgctaattctgagcaattaacggaactgtcacaatctgtattgaatttgttaagtgatgataatgccaatgtagatacaatgctctatcgtgctattcgggatttggaagagctagtcgaagtcgatagccaatatcaatcggcattagaaatgctcaatgaagccttaattcaagtacaggaagccagctctgaaatcaatcatcttgccaataaaatcgagcaagatcctgagctattaaatgaattagatcaacgcattagccaaacaatgcaactggctcgcaaacatcacattacccctgataaactatggcaaaaacatttaggcttaaaacaagagctacaaaccctattagattttgcggaaaatgaagaacagttaattgccgatgaacaacaagcctatcaacaatgtgttgaattagcagaaaaaatttatcacaagcgggtagatgcagggcaaaaactgtcagcccaagtgaccaaacagattaaacaattagcaatggaaaacggcgaatttttcattgatattcagcataatctcgacaaattatccgcaaatggggcggatttcgttgaatttaatcttcgcagtaacttagggcaaaatgcacaaccattagccaaaattgcctctggtggcgagttatcacggatttcccttgcggtgcaagttttaacggcgaataaactttcaacgccgacgattattttcgatgaagtcgatgttgggatcagcggaccaactgcaacggtagttggcagattattacgccagctaggcaaaaaatgccaagtgttgtgtgtaacccatttaccgcaagtggcaagtcacggtaatcatcattttaacgtgcaaaaacaagttgaaaataatcaaacagaaaccaaaatgagcttgctgacaccaaaagaacgagtaaaagccttagcccgattgttaggaggggaaaaaattaccgatgctgtgttagcgaatgctcaggaaatgttagatttggcagaacagggttaattcagtggaatacaaaaatgcctttgttaaagaaaacaaaggcatttttttaacaatagaaactattatttgtctttggtagcagttgcaccaataactccttcccaattcttttgaggggtatgtggtgttgcatcttcatttttcgcttttcctaataaaatctcgccacttttgccatataaaccaccatcaaattgccctgcggggatttttggtttacccatcaaatataaacgagtgaaaatataaccattttcactaacatttgtttgattagtagttaaatcgtttccattcacaccataaatattaattgaaattgatttattcatatgtttataggttgctgtaacattagcctctttagcttgttcaggagcatccttgagagtatagtacatttttccttgataagataaatcgtgagttggacgagttttggcttcttctctcgcggtcacttcttgtaaagccatatatttgcgttcaacattgttctcatcaggcctatatggatctggttttgttttacttaatgtcgcataaccataatatccaaccaaatttccatcggcatctcgtaacgtattcattttactattatttgaatggctaccactgactggggctagcttgatttctttgccttcaagggtaatactcacccaattgctcgcatcgtaataaccaccatttttcgagaagccctgccaaatatcttgatcattcaatttttgagagggaggctctattttttccttagattgcttaccaacaattggctcttttatttgcttatcctcttttgcttcgggagctttgctagcattatttttatccaaagattgggggttattttcacttacttgttgattagtaataggatttcctgttttatctacagcttgctgatgaccaccacttgaaccaccgccaccacaagctactaagatgcaactagcaagtaatgtaatactaagtttttttgttttgttcatatttgtctcctcatcgattttagttagtctgcaacatcaatatcaggtgacattccacctaaattatacgcttctaatttcacagggctatttggctcaaaattaaaaatcgttacagtaccttgtgttgcaggtagtaagtgatttgcagaaagtgaaacgaagctatggcaagcggctcgaataacaccactatgtacaactgctagaacatctccattactctctttcacccattttatcagtgtttctgatactctttgacaaaattgatgccaattttctccgcctttaggtgtgtaatcacctcttctccaagcgtggtacagttcaggattttcgtcaattaactcttgctttttacgtccagaccattcacccatattgagttctcgtaatcctttatctttaataggatcttgaaaaccaatgatttccgctgtttgtactgctctacctaagtctgaagaaatcaccgttttcggagataattgttgaattaacggttttattgcatttgcttgagatattcctcgttttgataaaggggaattataatgtccttgcaagcgtttttcaatattccataacgtttcgccgtggcgtagtaaaatcaatcgcatatcaaactccttataacccataaccaagcacttggaaccaagtaaatacagaaattgagataactacagcactaataaaacaggttatcagtccgtatttcatttgatctattacgctaaaataccccgtagcaaaataaatcgtgtttacttttgaatgtggtggtaatgtcacggtataagttaaggtaaatgatgctgcaagagccaatgtcacaggatccattcccaaagtttttgcaagtgcaataattgacggaattaaaattgtcgttcttacagttttactggtaaaaattaagtgtctgtacatacagacgaagatgactacaacataaaccaatgaatggttcatcttttctaatcctaaaccttccacgacatttcccataatccattgagcccctttagtgctttccagagtatttcctgccgcataagctccagcagcaaaaagcattaagtcccatttaatttttgcttcattccaagtcaataagtcaacttttggtagcaagcaaagtactgcagcaattaccgctgtcatataaacactgacttcaaaaccaaaccaacccttttgataatcttccgtagcccataggaacaccgcagtaaagaaaatcgccattgcttttttctcatcaagagtgagtttgccaagtttagaatactctgtttgtaaacgtcctaaggcttcactaaaattactctcttttttcattgaaaataatttaaaaccaatcagataagccaagaacatactcagcagtgcagtcggaaaagaagcaataagccagtcaatataaccaatatctgctcctgtttgattattaataaaaccaacagcaataatatttgccgcagttcctgtcattacccctgatgttgcaatagcatcggcttgcacaccttgtaacatcatcaacttaccaaaattactttcacctgggattactcgatagatttcaagcaaaatcatacagatcggcaccattaaggttgctcgagtagtggttgatggcacaaagaaaacaagcacaaagttgattaaaataagtacgaacaatgcttttttcgatgtttgcccaaaatgagtaatcatccataacgcaaaccgtcttgcgatattggatttaatcattgctgacgttaggacaaatgcagataccattaaccaaattacatcgtacctaagagtagcaaaaactgctttttctttcgctacggtatgtgttaaaggtaataaaatgatgactattaacgaagtgagataaataggtaatgaaccacaaacccataaaaccaaagcactgcagaaaatagcaatcgctttttgcccttcaatagttagcccttcaggggtaggcataaacatcaatccaaacaacacaattagagcaagaggaataccgatttttttcagaactccttctttgttttttgtattagaagtattcataactttctcccaaatgaatgaatttattttcgacacattatagggatttgaaactatttcaataattgtgttattatataaaaatcataaaaattatttatggataagcctatgaacttacaacaactaaaagccttcgtggtgttgtctgaatgtttgagtgtcactgaaactgcagaaagactattttgtactcaaccctcagtgagtattaagataaaaaatcttgaacaatcattagatacggttctttttgagcggatcaataaccgcctttttttaaccgaacaaggcaagatatttcgccaatatgcgttgaaaattcttcaattacttgaaactgctcaagaacatattcatcaatatgatgatccaaattacggtaaaattacctttggtgctagccattttgttggagcctatttgttgccaaaagtcattgcaagatacaagcaaatcgctccaaatgtcgaaattcgaatggatattctcccttctcaacagcttatccaacgtttagaaaaccacgagttagaatttgcaattatgtctgaccaagtttgctttgagaataaagaaaaagagtatgttagtgaaagttttttcgatgacgaaatggtattaattgcttcatcaacacacccattttctcagtacaataacgttgattttaatgctattttagaagaaacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggggatttcgttgatcataacccaaccgttaagaatttagcacttgcattcttaatcttaatcggtatcgcattaatgggtgaaggctttaatatccacattccaaaatcagcgatttacactgcaatgggcttctcggtgattgtagagtttatcaacattaaaatgcgtaaaaaccaagaaagatatcggaaataaatcataaaagctctccagattaggggagcttttgtattattaatatatgcacttcctataagtaggtatacattaattgcaagaaaataaaagaattaaactatgttaattaaattattacgctttatcatagcaatcacaatactatttttactactttacttgggtaaggtgctcagcccattaataccgattcgtattcctgaaagcattctaggaatgttaatgttatttattttgtttggaaccaaaataatcaaagtgagcagtatcaataccgagatgtacaatgttgaatacaattaatgagatacacacgtgatttatataaatgttgaatttgattaccctgaaatgctaatgcagtttcaactcaatgtaaaaaaaggggaacgcattgcggtgattggtgaaagtggtgcaggcaaaagcaccttgcttaacctaatagcaggttttgaaaaagcggatcgtggggaaattttactcaatggggaaaatcattttgctactgaaccagcccaacgccctgtgtcgatgttattccaagataataacctttttccacatttaacggttgctcaaaatatcggtttagggctagtttctcgtttgcattttaatgctacacagatgcaacagattacgcaaattgcagaacagatgggcattgctgaactgttagaacgccgttcggatttattatctggcggacaaaaacagcgtgttgcactagccagaacactgcttagagataaaccgattttgttgttagatgaacctttttctgcccttgatccacaaaagcgaatggaaatgcaacaactggttgtagaattatgccaacagaaacagctcacgttactgatggtgacacatcaagtggaagaagtgagcaagtggtgtgatcgggtggttgaagtgaaacaagggcatttgatttactagtcaaaatctaattttttcagtaagattaaagattattttatatcggatttaaaagaggttattgtgccaaatcgtgattatgctgttcggtctaaagccaaaaaaggtggaaatactgcactgatcttagcagtgattattttattattgatgggaagtgggtttgttctctggtttttaaaagaaagcaatccaaccacgcctgtaatgccgacacaaatggcaccatcacagcaacctaaaagtaccttgccaaccccaccgcaagaagtatatagctacattcgagatctagaaaccagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttcctgtggataaaaattctaaattggcacaattaaccaaagagcaagagttggcaattcagaaacaaaaagaagagcagcagttaagccaaacagcaacatctgatccagtcgcaaatacctcgacagcaacagaacaaaaacaagagcaacaacaagaagttagtgaagaaaaaccaaagcaagagcaactcccaaaaacacaagaacaggcaaaaaatattacaacagcaaagcctgcttcagagcagcctaagaatgtcggaaaatttggtttacaatgtggtgcatttaaaaataaagctcaagcagaaaatatgcaggcccgtttagctatggctggttacaatgctcgtattaatagcaatggtgaatggaaccgcgttgttgttggtccagctggagatagagctaaagcaatggcggcgttatctaatgctcgtagtgtagcagaatgtgtcattattggtatgtaattaaaaggaaacaaaatgcaatttaaagattatttagcgactttccctagcattgaacatttgtcaggcttatctatattggatagacaaggaaatatcattcaccatattcctgctattgaaggtaaattaggttcattaaaactgtataatgcacttgcagaaagatttagtcagcagctgaatgttaaatctgctcagcaaggaattatttggtttgctgagcatgttgaagatgcaactcaacatccagggaaacacccgaatattgacttattatttaatattgttgaacaaaaattagagttgacattaaaacctattactaatggataaaaacttatcatttatgagttacttaactttacagctcttattttcataaagttgtagcaggtatagtagacaagcattattgcacagaaaacttcaccggcaccgttagcgatgtagggaaacctgctggaggaggcgagtgcatttttgtgctttgagccgctttcattgctgccgcatccaagttgctattccctgacgaattaatcacttgaacattaattacttgccctgatgacgataactggaatgataaggttactgtccctgtttttcgcatcattttctctctttgaggataagcattgttagctctttgctgcaacgtccgttgtaattgagctttataagcgttaatttccccaccacttgctgagccactatttacagtgccactaccttttggtgagccagttacaataccctcttgattttttgcaccttgcaccgcactcggaattgcttttgctacaacaccttgtttagcttcggcacctttctcaatggcttttacaggaggtttttcttttggttttggcttttcttttggcttcggtttttctttaggtttttcctttggctttggtggctctggtacaggttcaggaataggctcaggctctatgacaggctcaggtttcttaacttcttcctcaacaggttcttccgctgccaccgctacttgttcttgctctaaacgtgccgctaacatttccattgaaatactggaaacttcctctgttgcaggtaatggtttttgagtatggataatcccaaacaccgttgcaaatagcgtaccgtgtaaggtgagagagccgattaatccgatacgggagtgacgttttttcattacttactgttctcttttttcgtcactattgctacatttttgatttgatttgcagccagaagatcggttagctcaacaaatttttcaaaggcaacggtcgcatctactttcaaggtcaccttttggcttttatcccaagtcgatatttctgcatttagttcttctttagtgatcggtttatcattgtagaaaaattcattattttcagtaatagtgagcagttttgctaattcatcagccttcattgcttgtgtagtagaggctttcggcacatttacttgaattttaccttgcgagataaaagaggcagtaactaatacaatcgctaatagcaccaacataatgtcgatgaatgggataatgtttatttcgtcaaattttttcattatatcctcgtcgcttgtcaaattttggcagaaagtgaccgcttaggctttagctttgcgagcttcaagggcttgccattttaatttgttttcttcgactttacgtccaaagccgttataaaacatcattgcaggaatggcgactaagataccgacagcagttgctttgagggctaaagagagatgcaccataatagaggcagcatcaatatccccgccagaatgaccgagttcatagaatgttaataagataccgacaacagtaccaagtagtccgatataaggggcgtttgagccgatagttgagatagtggtgaggttagcagtgagatcgatttctaactcttgcaatgtttcgtaatctttgacttctactttcttataaaatagaactcgttcaatgattttggcaaataaaatcacactcattagtcctaataaaccaagaataatatagtcgatgtagctttgtaaaaattgaaatagttgatccattgaaaagtcctatcatataaagaaaaaatgcgtatagaattacgcatttataatagttcctattatataaaagtgagttgaaatttcaactgctgtaatagcttattgtttatttacaattttgtgtttaatgctatatttcctcgatttcaatagaggaaataatatggaagaaacatttacagaaattaccccacaacaagcgtgggaaatgatgcaaaatgaagacgctgttttagtggatattcgtgatatggtaaggtttagtcatagccgtcctcaaggtgcatttcacttaacaaaccatagctacggcaagtttttagatgaatatgattatgatgaacctgtgattgtgagttgttatcacggggtgagtagtcgtaatacagctcaataccttgtcgagcaaggttttgagcgtgtatatagtgtcaaaggcggttttgagggctgggttagatctgaattaccgattgaattaggctactaggctaacaagtgcttggattagatgggaagaattaaacatatttcataagagagaacaaattatgtggaaagaaatcttacttaattacggtatctttttgctggaattattgacggtctttggcattgtcgccgttgtgataatgctgattttagaaagtcgtaaacagccagaatcaggctcaattacgctgactaatttaactgagaaataccaagaacaagaaaaagcacttgcaagtgcctttttaagtgaagctgagttaaaacataaagaaaaacaagagaaaaaagcagaaaaagagaaagcgaaagcagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagagaaatcccgtttgtttgtcttgaactttcaaggggatattcaggcgagcggtgtatctgctttacgcaaagaaattgatgctgtacttgctttggcaaaaccagagaaagatcaggttttgttaaagctagaaagtccgggtggcgtggttcacggttatggtttagcggcttctcaattacaacgtttgaaagacaaatccattcctttgactgtggcggtagataaagtagctgcaagtggtgggtatatgatggcgtgtgtcgctaacaagattgtatctgccccttttgctgtaattggttctgtcggtgtggtagctcaagtacctaatattcaccgtctattgaaaaaacacgatattgatgttgatgtgatgacagcaggtgaatacaagcgaacagtgacacttgttggcgagaataccgaaaaaggcaaacagaaattccagcaagaattggaggaaactcaccgcttgtttaaacaatttgttgctcaacatcgtcctcagttagacatagaaaaaattgcgacaggtgaacattggtttgggcaacaagcagttgaatttaaccttgttgatgaactctctactagtgatgatctcattttagatgcggtaaaatcgcaagacgtgattgaagtgaaatatcaacaaaagaaaaaattatcgcaacgtgtgggagagcaaattgagtcgagcgttgagaatgttgtgataaaatgggtgaataaatctcgttcaccacttttatagataacaattgtttgattaattttaaattttcattaaattgtcgaataaatagacttcccaaatggcgaaaaaatgcgtattatacgcgtccctgagttagtaggcgataatgatgctgaacactgaataaaggttgtgaagtacggttttacaccgtactttttatttggatatcgtttaggttaaatttgtactaaaaataatcaatggataagtcgatgcgaattggtcaatatgaaataaaaaaccgtattttcctcgcgccgatggcagggattacagatcaaccttttagaagactgtgtagccaattaggtgcaggtttaactttctcagaaatgatgtccacaaaccctgatgtatggcataccgaaaaatcgaaattgcgtttatcgcatcatcacgaaatcggtattaatgctgtacagattgcgggatctgatcccactgaaatggcagaagcagcaaaaatcaatgtcgcttacggagctgaaattattgacatcaatatgggatgcccagcgaaaaaggtgaacaaaaaaatggcaggctctgcccttttacgcgaacctgatttagttgcccgtattttagatgcggtcgttaatgctgttgatgtgcctgtaacgctaaaaattagaacaggttgggatcctgagaaccgaaattgcctagaaattgccaatatagctgaacaagcgggtatctcagctttaactattcacggacgcactagaagttgtttatttgaaggtgaagcagaatacgacagcataaaggcagttaaacaagcggtttcgattcctattattgccaatggtgatattacctctgcggaaaaagcaaaacgggttcttgactatacacaagctgatgctgtgatgatcggtcgaggcagtttaggtcgcccttggttattttcggaaatcggcaagtttttcgagaaaggagatctcgtttcgacattatcacttaatgataagtgccaattaatgttacagcatattgaaaacctacatcagttttatggtgaagaaaaaggttatcgaattgcgcgtaaacacgttggctggtatgtcgaacagcttaaaccaaatgcaaattttagacgtacttttaatgcccttgattcgacgaaagaacagttaaaggcgttggaagattttgtaaaatcgattcgtgaagaatctcaataagttggataaaaggacaatgttagaacaacaaccgacacaaaacccattaacagtatcaatgttaaatgcacaagctcaacaagtagatagaccacttcgtgaaaatgtaaaacaagcggttcgtaactacttaagaaatttagatggtcaagatccaactgaattatatgagttagttttatctgaaattgaacacccaatgttagatatggttatgcaacatactcgcggtaaccaaactcgtgcagcgacaatgcttggtattaaccgtggtacattgcgtaaaaaattaaaaaaatacggtatgggttaatttttttgtaaactaaatcatatcattgaatctgcactttaatcgttaggtttagtctctaacatcataaagtgcagattttttatttatagagtgtgagattaagtcgatatccttctttgcgctatattttgcttgatttcattaataaagtgaaatatatagaataatgtcattactactaaggcagaaaaggattaacattaatatactgcgaaatggtaagttcgtaattttttagcaaaaaattaaggaaatctcaccgcttttttgctatggtacgccttaattttttctaatgagaacgaaacaatgaacgacgctcaacaatctcaacaaccacaatcagaaaccacccattttggctttaaaaccgttgctaaagaagaaaaacagcagttagtcgccaatgtattccatagtgttgcaggaaaatatgatttaatgaacgatctgctctctttgggtattcaccgtgtgtggaagcgttttaccattgattgcagtggggtgcgaaaagggcagaaagtgttggatttagcagggggaacaggggatttcaccgctaaattttctcgtattgttggcgaaactggcgaagttgtacttgccgatattaacagctcaatgttggaagtcgggcgtgaaaaattgcggaatttgggcgttgtcggcaatgtgaattatgtgcaagcgaatgcagagtgcctgccgtttgcggataacacctttgattgcattgtgattagcttcggtttgcgtaatgtcactgataaagataaggcgttacgttcgatgttccgtgtgttgaaaccgggcggacgtttgctggtgttggaattttctaagccgattatcgatccgattagccaagtttataacttctattcctttaatattctgccgaaagtgggcgaagtggttgtcaatgatgccgacagttatcgctaccttgccgagtctattcgtatgcacccgaaacaagacgagttaaagggaatgatggaaaatgcagggtttgaaaatgtcggttattacaatttaagtgctgggattgtggcattacatcgtgggtacaaattttaaaaatgaaaacgttattacaacagttgatgttaccgcaatttgcgttaggggcattggaaacagcgtttaatcatttgattgaacgttcaccccaaacatcgccgatgttacgcaaacttgcagggaaaattcttaaaattcagttaaatcaaccgaatattatactttttgtgattttcagtgaaaaccgtgcggattggctggcgaattatgagggtgaagttgattgtgcggtgagccttgatgcgacagctctcccaaaactggcggataaaagtaaactgagtgagttgattaataataaaacactgattttgacaggcgatattcaagtattacagcatttttcacagttacttgacgagttggaaaaagatcctgcggaattgctctcacgttttatcggtgatgtactggctcaggcttcaacggactttgccaaaggtatttttaccaaggtgaaaaatcagtttgtgcaagacagtcagcaccttgtcgataacttgacgaccgaacgcccagtgcttgttcatcgtttgcaagtggttgatttttgcgatcaggtaaaagagttggaacaacaagcggagagattagagcagaagtttgcaaaactagcattaaattagaatttattttcccttcccccgtttacgagggaagggaataagttggaaaaaaaggaaataaatgaacatcaaaaacctgcgtcgtctttatcacattattcacacctttcttcgctatggtattgatgaggtgattccagatattccgttaacacgagggattcgttgtgggcggaagtcgttattttgggtaaaaaatcaatatccgaatgagcctttcggcgtgcgtttacgccttgcgttgcaagagcttgggcctgtatggattaagctggggcagatgctttcgactcgtcgagatctgtttgaacctgagttggcagatcagcttgcgttgctacaagattctgttgaagcttttgacggaaaactggctcgtcgtttaattgaagaggctctaggcgataagttggaaaagtggtttgatgatttcgatgaaaccgctttggcttctgcgtctattgctcaagtgcatacggcaaaatttaatcaaaaccaaccgcttgcaggtaaagaggtggtattaaaagtccttcgcccagagatggattgtgtgattaaggacgatttagccttgatgtaccgcttggcgagttggattccacgtttaaataaagaaggcagacgtttacgccctgtggaagtggtgcgtgagtatgaaaaaacgttgttggacgaactcgatcttcgcaaagaaatggcgaatgctatccgcttgcgtaataattttgaaaacagtgaaatgctctatgtacctgaaatgtatcaagatttttgccataaaaatgtgattgtgatggaacggatttatggtattcctgtagcaaatattgatgaactaaaagccaacggcactgatatgaaactgcttgccgaacgtggtgtgcaggtgttttttacgcaggttttccgtgatagctttttccacgccgatatgcacccgggtaacatttttgtgaacccaaatcaccccgaaaatccacaatatatcgggattgattgcggtattgtcggcaccttaaatcagaacgataaacgctaccttgccgaaagttttgttgcctttttcaatcgtgattatcgccgagttgcgttaatgcacgttgagtcaggctggacaccggcagataccgatattgatgcttttgaagaagcctttcgagaagtctgcgaaccgatttttgctaaacccctttcggaaatttcgtttggacacgttttgttgaatttgtttaccgttgcccgtaaattcaatatggaagtacagccacagttggtgttattgcaaaaaacattgctttatattgaaggattaggcagacaggtttatccccagttagatttatggcaaaccgctaagccgtttttgcaagattggttgaatgaacaagtgggctttaaggctatgtggcgagatctaaaacagcgagctccgcaatttagagagcattttgccgagtttcctgaagcgatgtttcaagccttgcaacaacaaaaacagattaattttcgtttaaatgaaatcaatcaaagcctgaaagcacaacgtaataacacgggcttttcccgtttgatgattttaggcatagcgattgcgggtacgttttggaagtttgaaacgttgccgttgtgggtgagtgtgccgttgttagttattgaattccgtatattaatatggtgtatgagttttagtaataacagttactcataatgttttcctataaataaagatattaagttagatagggagctttttaaagattttgttatgttttatgtttgtccttgccaatcaaaactagcatatgatgaatgctgtaaaccatttcattttgctcaaaaactgcctattacagccgaagaattgatgcgttctcgttattctgcttacaccaaagttaatattgactatatagttagaacgacactccctgctcagcaatcattgcttgacctaaaagcaataagagattggagtcaaaagactcagtggataggtcttgatattatttctaaccaagaaaatgtgactaaaattcatagtattgttgaatttagggcttactttaatacagaagatggtgtgcaaattcatcatgaatgttctctttttgtaaatgtagatgatcgttggtatttttttgatccaacagttcctatgcctgctatgaaaaaattgtgtatttgtcgatctgggaaaagattcaaggattgttgtggccgttggatatgattcttcgagcaatcctatttttgtaactattttgtggagaatgcactagatttttaaaattgctattaatacttgtttataaaagataattggcacacgtccccgtaaccacacggggatacgattttcctgccaaatctttttcatctcttctcgatggtttttgccgtaacactgcactttgcttggagagcggttggtcaggcgaagtggggtttgttgtaacgtttctggcaataacaagcggtgagatttgcctgatattttgtaaataatctctgtgccgttgcgttgaacaatgccaatagaggtgggcagttgaatttcttcactttgtggtggcagttccaagtcaaaatcatctgtctctgcttgaataggggtaatgaagatctgctgttggtaacggcgaataaggtgttgttcaagtttgacctgcggatttttatcggctcttgccaaaatgagatgttggataatctgttctagttgagccacgcttggcattgcaagatgagcctgtgccagccacaaacggacaagctgttgttgctttaacaaagaaaaatgctcaaagcctgtgatgtctaaaccgccattttgtagccgactagccagttcggggtgtagcaattcttcaatcagttgttgttgctcggcacaatgctggcttgagcgtgccaccatttgattaaactgttgccaacgttgattgagcaaaggtaacgccgtttgacgtaggaaattgcggtcaaaatcagtgttgaagttgctttcatcttcaatccattccagttgatgttgttcagcataagcgagaatgtcggttttattgaagctgagaagcggtcggaaaatcgcaatattttgcaaaaaactgaccgcttgcattgcccctagtccttgaataccacttcctctttttaatgcaaggaaaaaggtttcaacttgatcgtcaagatgatgtgcggttgccaacatttcattccgttgaatatgctgttgaatggcttgatagcgtgctgttcgagcattggcttccagcccttgcttgccttgtacttgaaccttgcagacagtgaaagggattgcccactgttcacaaagctgttcacagaatgttgcccagctatctgcatttgggcttaagccgtgatggatatgaattgccctgagtttaaggttaagggcttgtcgagcctgtgcgaacagatgcagtaagactaccgagtccaccccaccgcttaaaccgatgaagaaagcggtctgattagggcaatgctttgcaagttgttgctggaactgttggtacattgccgtgcctatacttgtagccaaagggtgacaggcccatcgttctgtaagctgacctgcatatcggcggcgaaccgtcctgtttgggtatggattttgagtgccgcttgctgatgaaaatagtcgtaaagtgcttgagcaagtactggggttgccccacgagagaagctaggacgtagacctttttgggtatcggcggcaagggtaaattgggaaacgactaataaacttccccctgcttgctgaacgtttaggttcattttgccttgttcatcggcaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgatagttcaagactttttccagtaagcgatctgccttagcctgatcgtcaccttgctcaacacctaataatactaatagtcccgttgaaatttcgccgacagcctggttatctacttccactttcgcccattttactcgttgaattaatccgatcattctctgtcctccgttaatggatttgctaattcgccagccttgatcatttccatatcttttaatacagaagcaaactgcccccctaataataccactcgccagcttaggtggatccaaacaatcataatcggaatcgtggctaacgcaccataaattgcctgatatgatgggaaagtggtgatataccagatgaaaatttgtttacccagcgtaaagaaaactccagcaaataaagcccccaccgcagcgtgtctaaacttcacttgggtgttaggtacaataagataaaccaaggcaaacagcaaccaagttaagacaaaaggaataaatttaagcaggtggtggctaaaagaaaacagtccgtcttggctaaacatttccaacgagaaaatataagagctgatggcaatgctcgctccagcaaaaatcggggcaaaaatcagcacagctaaatagacaacgaaagagagtatcactgaacgttttttcgtattatgccaaatttcgttaagggcattatcaatgctcgaaatcaacatcaccgccaccacgactaagccgatgatactgatgatccccattttctttgagttatcgacaaacatctcaagatattgctgaaccatatcccctgcacttggggcaaagttatcgtacaccagctcttttaactgtgcggtcgcttgttcaaaaatcggtaatagcgtaaacaccgaaaacaccaccataatcaatggtacgagagagagcaaggtggtataagtcaaataccctgaatagaccgcaattttgttttgctgaaagcggtggataaagagtttaaaaaagaagataagatttttcatattatttccccttaaggtggggaagtttagcatagcttaatggcttgtggcatattctgttggggttttgtttgcttgtattaagttctctcttaatctgtggtcaattcgaaatgcctctttagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatatggatatttccattctggtcttgtgttaaatcatagttcactaagcccgtattgttcaccaaaatctgtttgctatttggatcaattaaagcaatattaataccttctctttgaataagataacgagttacatcaccgacacgggaggttacaaaacttagctcttgataattagcaagagctgcttttaacgatttcaccgctcgatgttctgcggtttctggttctgttggtttaacctcgcttacagtcgctgtttcagttgaagctaggcttggagtaggctcaggtgctggctctgcaacttcaggagttggcacagcggtcggttgctcgcttgtttctgcaacagcttcttctgttggagggacttcacttacagtctctgtttccgatgtctctgtatttgatgattgagcatctacatctgtttcttctggagctggttctgtcgtgactgtactcgcttcgttagtattctcagctactgtctctgtattggttgaactattattttcagttgcagtagtcgttgttgtactgttactaataccacaataactagcatcagctcccggagctaaacttaatttacaatcctctcggttagtggtgtctttataagtaccattatttcgcgtttcatcaatactcacataagtaatgctgtaaatatcgtacacatcggtgacatatttatttccatttggaacatagtaactataaagaaaacgaaaaatttcattacctttattatcaagtacataatcccctgtcacctcaaccattttaaggtttcctgcctgatctgctacagagtcactgatataaccttttttaattttgccagttttttcatctacctcaatgccccataaagtcacagtatgtgtccatgatgttagcgcggcaacaacgtttccagttttgaagttttcaaccaatgattttgtaactaaagctgcattagagtcgtaacgctcagtccaaaatggaccaccactgatttttgttggcccacgctgtgcctcataagaagttttcgtattatgagtttcatataacttaacagtgggagcaaaatcctcaaagaaatattccattccacgaaatgggtataatcctccctgtatgtttggatatttcttatttaaccattttgaaatctccttattatcgtttggtgtattgggattaaataaaacaggggtttttaattctcttttccaccaaccaagcatatttcctgcaacagctccccagcattggttaggatattgaaaatcagcagtccaacctttttgcttatcaactccacttgcccagtagacatcgtttgccaaaacattaacagaggatgaaagtagagcagttatcaagaccttcgaaaaataaggcttcatattatgatctcctttaaatttatggaaagaatactgaaattatactggtaggaaaaatttgaatgcttttataatagctcattgattaacgatgagaaatacaaaaaaccatcagttaaatttcaccgatgggtgattgtaaactttttaatcagataaaactttgagcaagctcaatatatggttatgaaaatgtcgatattatctaccgcctatttcatcacgctactttacattgctctctctgtatcgcacgatacccaatatctcgacggtaaaaatgcccttgccactgaatctgttcagccagttttaaggctttttgctgtgcgtcagatacggtggaacctaatgcggtggcacagagtacacgtcctccttttgtgactaatttcccattctgttggctaacacctgcgaggaagacctttttatcggcacaacaatctgtcggaattcccgtgatttcatcattttgacgataatctgcaggataaccttcggcagccagcacaatccctaacgctgcttgttcacaccattttgattgtatctcgtttagcttgccgtcacaggcttttagacagagttcaacaagatccgactccaatcgcatcataattggttgtgtttcaggatcaccaaaacggcagttaaattcaatcactttaggttgtccatttggcataatcatcaagcctgcatagagaaaacctgtatattcattattttcactcgccataccacgcactgtcggataaataatttcttgcatcacacgttgatgaacatctggagtgacgacaggggcaggggaataagcgcccattccacctgtatttaagcctgtatcgccttcacccactcgtttatgatcttgactggttgccattggctcgacgtttttaccatcgaccatcacgataaaactggcttcttcgccagctaaaaattcttcgataacaacacggctacctgcgtcaccaaacgcattgcctgaaaacatatctttcactgcttcttcagcttccgccagcgtcattgcaacaattacccctttacctgcggctaaaccgtcggctttgatcacaatcggagcatttctctggtataaataggctaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaggtttgatattctgctgttggaatgttgtggcgagctaaaaagtctttggcaaaggcttttgacccttctaactgggctgcagcttgagttggaccaaaaatttttaatccagcggcacggaatgcatcaacaacgccgataactaaaggtgcttcaggtccgacaatggttagccccacctcattttctttggcaaaattgactaaagcggtcagatccgttgcagaaattgccacattttcaattccagcttcaagcgctgttcctgcatttccaggcgctacaaaaaccttttccgctaaaggtgattgacgaactttccacgccaatgcgtgttcacgaccaccgttgccaataatcaaaatattcattgaaattcccctgtaaaaaatcgctaaagatctgaccgcttgcaaaaagcaaacgtttgcgtagtgtatcggatttagtgatgaacaggaagcattatttattgagaattagcattaatatctatctataatcatatatccaacattctatgctaaaatctctcctattattttttacagagaatcaactatgacaatgattaaaattgcacaacaagccaaacaagcgagctttgagttagtacagtttggcaatgttcaaaagaaccaagccctgttcgcaattgccgatgcgttggaacagcgtaccgaggagattttagtggtcaatgcgaaggatattgattatgccaagtcgcaagggatttcagaggcgataatcgaccgcttgttgctaacacctgagcgtattcgtgggattgcaaatgatgtgcggaatgtggcgagccttgccgatcctgtcgggcaggtgattgacggcggtgtgttggatagtgggttgaaaatcgaacgccaacgagtgccgttaggggtaattttgactatttacgaagctcgtccgaatgtgaccattgatgttgcttcgctctgtttgaaaacaggcaatgcggtgattttacgtggcggtaaagaaacgaaatttaccaatgcaattttggttgaagtcgtgcaatctgccttagagcaggctggcttaccgaaattagccgtgcaagccgtcactgatcctgatcgtgcattattgctcgaattgctcaagttggatcagtacattgatatggttattccgcgtggtggagcaggtttacatcagttctgcaaagaaaactcgactatcccagtgattgtcggcggtatcggggtgtgtcacctgtatgtggaagccagtgcggatttagagcgttcgctgaatgtgattgccaatgcgaaaacccaacgcccaagtacttgtaacaccctagaaaccttgttggtcgataaggcgattgcagatcagtttttaccgaaactcgccgaacatctttgcaaattgaaagtgacattgcatagcgatgatttttctgaagatctgcagaaaaatccgcaaatccaaccgcttgaacaagcaaaattacgtcaagagtggttgtcgttagacttaagtgtggtggttgtagatggtattcagcaagcgattgagcatattcgtaactatggtagccaacactccgaagggattttaaccagtaactatgctttagctcgccaattcgttcagcaagtcgatgcggcggcggtatatatcaacgcaagtactcgttttaccgatggagcacaatttggcttaggagcagaagtggcggtcagcacacaaaaactacacgcccgtggacctatggggctagaagcactcacgacctataaatgggtgtgtgaaggggattatttgacgagaaaatagtgtctcaaagatataaaaaacatctatgaaatataaagagattcaatatttttaagctatactacataacatagggaatcttagatatatcttgcgctggtacaaagtgttaagcgctaaaaaaatttacaatgattcgtcaatacaatttaaaaacacatccaatgatttaaaggagaacataatgaaaccttatctttcgaagatcgtaatagcgacacttttttcttcatctgtacaggtagttgaagctcagacttattgggcaagtggagtcaatcaaaatagtggatggactgctgatttacaatatccaaatcagtgttggggcgctgttgcaggaaatactctcggatggtggaaaagtagagtaaaagcgcaagtagaatttcacgaggatactcctaaagatagcaaagccatttcaggatggatatataaaacttatccgcatatacagggtggattacaaccatatcgaggtatggagtattttttctctcgttttgcatcaggagtaaaattatacgaagaacataataaaaaaacgtattatgaaagtgagagaggtccaacaaaaattagtggtggtccattctggacggaacgttatgactcggatgccaaattagtcactaaatctttaattgataattttaagacaggaaacgttgttgcagcactcacttctcagcaccataccgtaaccttatggggaattgaagttgatggggatggtaagataaaaaaaggatggattagtgattctgttaaggataaagctggaaatcttaaaatggttgaggtggtaggaaattacgcaaaagacaataaaggaaatgatatattccgttttctttacagctatgccgttgacggtggtcgcatgtatgtaacggatctttatgatatttatagtattacctacctcagtatagatgaggcaagaaataatggtacttataaagatacatctaatcgtgaggattgtaggttaagtttggctcctggtgtgtcagaaagtttttgttcaattaatagtacagcaactaatactacaaaggtagagaatgtatctactactagcaataactcaacaaatcttccaacaaaagttgaaaatagtggccattcaaatcaagccattaatgctgcatcggcatcagatgatactgtaagttcagcatccgaaaataatgattcggtaaatacaccggaaaatatcaaaaacagtaatggggtagatataggtaataattcgacagtatcttcggcaaatgttgaaaatagtagtaatgaggttagtgtaattaatacaccaaatgcatcaagtctacctaacgatcaaggaactaaaaagattattgttgatagttcagaaagcaacgcaaaagatcctatcataagcaaagcgacagaatctttaacaaaggaaattaattcgtacccagaactaagttttatcactaagaatatgggagatgtaacattttatattgtgcaaaaagatggtgttgacataactttgattaatccaaaaactgaaccgtcgttagttagtaataagggattagtaatctatgatttcaaacaaggccagaatggaaatatccgcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgaaatccccaaatcaagctgcgatcaaagaagctaatgaagttacttcattgcatactgatcttaaccatgttgaaatgaacaatcttaataagagaatgggagagttgcgtggcattgacgccaatgcaggcgtatgggctagagtattaggcggtaaaggcagtagcgatagctataagcataaatttacccatattcagacaggttttgataaacaaagccacctttcaaatgcagagttatttactggggtaacagtgacgcatacttcaacagacattgaaggaaaaatcggctcaacaaacggcgatgtaaaatctatcggtgcaggcgtttatgcaacagcgttatttgataacggcttttatcttgataccatcgctaaatatgtcaaaaataaccataagtttgactacgcatttaaagaaatgaagttagattttaaatctcaacaatatcacacccattcattctatttgggtggtgaagttggttatagatttaacttaggttcaggctatgttgaaccacaagcggaagtgatttatgtcaaaaatagccaagctaatttagccgataacggacataaattaaccataaaagcctcaaatgggctggttggtcgtttgggtgtgaatgcaggtaaaacttttgaaattggacagagcaaagcgaccgcttgggctggcattggctatcaatgggatattgcaaaacgcaatgaaattttggtagatggtataagtgctagcaatagcaaaaaagatgccagaatgttgatggacttggggcttaatatcagagctaatgataagttaagtataggcttgagtttagaaggctctgtgtttggaaaatataatacggatttatctgttaattccaatgtaagatactcgttctaacatcaatatagggtaatttaagaagatcaaacttaatctagctacgccccaaataattggcgtatgtgagcttgggtttgatcttttgttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaggaaaaacgtaaaatttcttataaaatcaatccgcctttcgatatatctacttttacagcaactcttttaggagagcattatgttgaaatccattcttgttgccctttttctttttttacttctgttacatcagcccaaacaatgaaactctataatcggttatgcaggcgtagagaaaaatttatcacaggcagagttttggtttaatcagatttctaatgaacgtaaaggacaaattatcgatcagctgtttttcccttatgaacataagaaaattcaagcagattggaaagatcagtaacaattcgggggcaaagctatattttgtccctgatttcaagtagaataccccctaatttttgtcagaaaaggaatgtatatgtccacgcaatttgtttacactatgcaccgtgtcggaaaagtcgttccgccgaagcgtcatattttgaaagacatctcattgagcttctttccaggggctaaaatcggggtgttaggtttaaatggtgcaggtaaatccaccctgttacgcattatggctgggatcgataaagagatcgaaggtgaagctcgtccacaaccagggatcaaaatcggttatcttccgcaagagccgaaattagagccacagcaaaccgtgcgtgaagccattgaagaagcagtttcagaagtgaaaaatgcactcactcgtttagatgaagtttatgcggcttatgctgatgagaatacggatttcgataaactggcggctgaacaagcacaattagaagcgattattcaagctcacgatggtcataatttagataaccagttagaacgtgcagcagatgcgttacgtttgccagattgggacgctaaaatcgaacatctttcagggggcgaacgccgccgtgtggcactttgccgtttgttgctcgaaaaaccggatatgttgttattagatgagccgaccaaccacttagacgccgagtctgtggcgtggttagagcgtttcttacacgactatgaaggcactgtggtggcaattacccacgaccgttacttcttagataacgtggcaggttggatcttagagcttgaccgtggtgaaggtattccttgggaaggtaactactcttcttggttagagcaaaaagagaaacgtttagagcaagaacaagcggcggaaaatgctcgtcaaaaatccattgctaaagagttggaatgggtacgtcaaaatccgaaaggtcgtcaggcgaaaagcaaggcgcgtatggcacgctttgaagagcttaactcaggcgaatatcaaaaacgtaacgaaaccaacgaactctttattccacctggtccacgcttaggggataaagtgattgaggtgagtaacctaactaaatcttacggcgaccgtactttaatagacgatttatctttcagcataccaaaaggggcaatcgttggaattataggggcgaacggtgcaggtaaatcaaccttattccgtatgctttcaggtcaagaacaaccggatagcggttcaatcgtaatgggtgaaaccgtggtacttgcctctgtggatcagttccgtgatgcaatggacgacaagaaaaccgtgtgggaagaagtgtcaaacggacaagatattttaactatcggtaactttgaaatcccaagccgtgcctatgttggacgctttaacttcaaaggcgtagatcaacaaaaacgtgttggcgaattgtcaggcggtgagcgtggtcgtttacaccttgcgaaattattacaagcgggcggaaacgtcttattattagacgaaccaaccaacgatcttgatgtggaaactttgcgggcgttagaaaatgcgatcttagagttcccaggctgtgcaatggttatctcgcacgaccgctggttcttagaccgtatcgcaacccacattttagattacggtgatgaaggtaaagtcactttctacgaaggtaacttctcagactacgaagagtggaaaaagaaaacctttggtgcagaagcaacccaaccacatcgtattaaatataagcgtattgcgaagtaatagtcaaatcagccatatcttttatggctggatgtggctatgtttttttaatgtgtgtcattgatatgaaataaagataattttaaggaaccttttatgaccaaacattacgactacatcgctatcggcggtggtagcggcggtattgcttccattaaccgagcggcaagttatggtaaaaaatgtgccattatcgaagcaaaacacttaggcggaacttgcgtaaacgtaggctgtgtcccgaaaaaggtgatgttctatggggctcaaattgctgaagcgatcaatcgctatgcaccagattacggctttgatgtgacggtcaatcgttttgattaccgtaaattagtcgaaagccgtcaagcctatatcggacgtatccatacttcttacaataacgttttagccagaaacaatgttgatgttattcgtgggtttgcaaaattcgtgaataagaataccgttgaagttgccttggcagacggtggcgtagagcaaatcacggctgatcatattttaattgcaacgggcggtcgtccaagtcgtcctgcgattaaaggggcggaatatggcattgattctgatggtgtttttgccttaaatgatgtaccaaaacgtgttgcggttgtgggggctggttacattgcggtggaacttgcaggagtattaaacagcttaggggcagaaacccatttattcgttcgccaacacgctcctttgcgtactttcgatccacttattgtggaaactttattagaagtgatgcaccaagatggtattcaacttcatactcacgctattccacaagaagtcgttaaaaatgctgatggctctttaacgttaaaattggaaaatgctgaagaacaaagcgtagattgcttggtatgggcgattggccgtgaaccagcaacagacgtgattaaccttgaggctgcaggtgtggcaaccaatgaacgtggctttgtgaaggtggataaattccagaataccaacgtcgaaggcatctatgccgtaggcgatattattgaaggcggaattgaattaacccctgttgccgttgccgcaggtcgccgtttatcagagcgtttattcaacaataggccaaatgaacatttggattacaaccttgttccaacggtagttttcagccatccgccgattggtactattggtttaacagagccaaaagcggttgagcaatacggtgcggaaaatgtgaaagtttataaatcttcattcaccccaatgtacagtgccgtaacacaacaccgccaaccttgccgaatgaaattagtttgtgtcggcaaggaagaaaaaattgttggcttacacggcattggcttcggtgttgatgaaatgatgcaaggttttgccgttgcaatcaaaatgggggcaaccaaagctgattttgataacacagtcgccattcacccaacaggctcggaagagtttgtgacaatgcgttgatttttatttaaggatattttttatgaataaactattattaatttttattgctatattttctgtaactgcctgctttgaacaacctaagaaggatattattcaagaaaagggagaagataaagctgatgtagaaggactaaaagcggaagattcaaaagttgagtcgccaaaagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcatcaaaagttgaggcatcaaaagttgaatctctaaaatctgaggtctcagaagcgggagcttcccaagtaaaaattcctgattctaagaaggatataacagaggcctcctcatcagatgaaaaggctggagctagacaatctatttcagttcaaaatgaacattttggcgcaagatatcaatgagccagaatctcagaaatctagtaaacctaaatcgttacaatatagtataaatagacatcaagaatcttcggggctatccccagaagaggctagagtaggttatcaagacacttcggggctatccccagaagaggctagagtaggttatcaagacactctatcagatgagggaattctctatctaaaaatgcaatgccgttatcctcttatgtctgagcaagagattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagcaagagattattaattttggttgtgggacaaaagaagtaaaagtagcagaatagtttaattgcaacaattaagcgttttcagtattactcaatcccagccatcttatgcgtctgaatacttaactgccaacggggtttgttcggacgctggttaagttttcctagttgggtgatggtttctaacatattcatcaccccattttcttcacaaggggaaaggtagtaacgctctgctttgatggtgctttctatctgctcacaaaacgctagcacatcaccgtccaccacaattctcacttcattcgcaaagggaatgtgatgtttcaaataattcttctgatataaccgcttggggctagtggcgatgtagtcaatttgtggcggaacgggttttaagccattggtttctattgcaataaaataaccttctgctttcaaggtatcgagcagatacgctaaatcgggctgaattgtcggttcgccccctgtaataatgatgttctttgcggaaaaacctttgaccacttgcataatatctgcaagggttttggtttcgtattggttgtaattggtatcgcaccagggacaagcaagattgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcaccagggacaagcaagattgcatttaccaaagcggataaaaatactcggcatacctgtgttgaatccttcgccttgaagggtttcaaagatttcgacaattcggtattctggatttttcattatcggcagtactcacaataagacgttggggtttcccatagacgaataagactaacaggtagtccttccgttgtgagtgtgtcaaaaatgtatttcgccatctgctccgctgtggtgcgagcaggaataccaaaggttttggaatcgagagattgaagtaatgtggcaactttacactctttctcgcttgtcgaatcgtagataaaggcgtgatccattttgtcaagaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgagtatgggttcggatatagtcaaatgccccaagttgatcagctaacgcccaagtttcttttttcgtgagatacatcaacggtgtacggatattgaagttgtaatccatcgctaaattcagcgttacgttcattgatttaatgaatacatctcgacaatcaggataaccactaaaatctgtttcacatacacctgtataaatggtttggatcccctgacttttggcataaatggctgtgtaaagtagaaaaagtgcattacgcccatccacaaaggtgttaggcgtgttgcctgtctgcttaatttcagcttgatcgtccattaaggcattagtcgtaatggctttgatcactgatgtatcaattaaggtctgtttaacgccaagatcttgtgcaatccaacgggctttatctaattcgatggcgtggcgttgtccatattgaaaggtgacgacttcaacattttctttgccaaattcttcgatagcaagaaataaacaagtcgtagaatcttgtccgcctgaaaaaattacgacggctttaggtgtaggtttcattgtgttccttagttttttttgcgtgggaggtttgcgaaccacggttgaataaataagcggtacgatgttgcaatatttttgcattatcgcaccgctgtgaaaggcgacattataatggttttatctttttttgcgatttttctttttattatttacttatattaaatagttaatcaataaaatctatatttatcaaatttcaggtaagattataatgcaccccatcaagagcgatgtgataaatcactcgcaacatttaactataaacaaaggataacaaaatgaaaaaagttgcaaatgttcatacggcaccagcaaaacactgggtaggtaatgggttccacgttcaatcaatgtttagttataacgataccgataaaaatttagatccgttcttattgatggattacaacccacctcaccattttgatggtggacgcaaatcggattttcgtggtgttggcgagcatccgcatcgtggttttgaaaccgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtatcaaggcgaagttgctcacgcggactcttatggtggtggcggtactattgggacaggtgatgtgcaatggatgacggcaggttcaggtgtaatgcacgaagagtttcactcagagcgtttttcaagagaaggtggaatgtttgagatggtgcaactttgggtgaatttgccgaaagctcacaaaatgacaacaccaaaatatcaagcgattaaatcggcagatattcctgtggtacagcttgagaataatgcaggaacagctcgcattattgctggcgaattggcaagtacggctggtattgcaagtacatttagcccggttaatatgtgggatattgtactaaatgcaggtaaagcccatacttttgctgtaccagaaagccataatttgattattttggtgttagatggcacagtacaaattaatggcgaggacattgctcgtcgtggtgagttagtggcctttgaacgtggcggtgctgatgttcagatcgagacgaataacgatgctaaactgttaattcttacgggagaaccattaaatgaacctgttgtaggttatgggccttttgtgatgaatagccgagaagaaattatccaagctatgcgtgatgtacaaagtgggaagtttgggcggattgagaggtaaaagatagattaaactcttataatcaaggcttaagagctgctcttctttactttcgttttcatccttagctcttggtgatctcttaagagatcaccaaaattaattgattcattacttgttattagctttgaagatacattcccaatttttgattattacatcatgttgaaaaaatgaataatatctgtgatatgtgtttattttttcacaatgtatcttagagtgaactgaacgatagacttttagtagggggtttagtaggattggcaataatactttattgacaatattcaaagttatattggatgaagtgtaaaagtatttatatagctatatatcaaggagtctttatgagttcaatgcaaatcacgttatcatcaactgctgcctctgaagtttggggaaaaaatgcgattttatcggcaaacgatcaaggtatgacaatccatttggtaaaagatgaattagccaccattcaacaagcggctcgcaaaatcaaaaatcaaaacattttaaatgtggctttaacaggcgaaggttggggattagagcagtgttgggcgtttcatcaagggtttgttagtgtaaaaaatgcaggctcagtaacctatcctgcgttaaatgagcaacaagctgaatttgatgctcgccttgcgtgtagcagctttactcgtgacattattaacgaaccatctgaccgcttaacccccgaaatgttggctcacaaagcagctgaatttattttacaccaagccgataaatatgtcggcaaaggtaaggtttcttttgaaatcgttgctcgtgaagcattaaatgaacgtggttatcacggcatttggacagtcggtaaaggctctgctcatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaaaggctctgctcatttacctgcgatgttacaacttgactataacccaacgggcaacccagatgcaccagtgttagcctgtttggtcggtaaaggcattacctttgacacgggcggttatagcttaaaaccaagtgacagtatgtccacaatgcgtaccgatatgggtggagccgccttagtcacaggggcattaggttttgctattgcgcgtggcttaaaacaacgtgtgaaactctatctttgctgtgcagaaaatatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaaatatggtgagtagccgagcattcaaattaggggatattattacttatcgcaatggcgtaactgcagaagtgttaaataccgatgcagaagggcgtttagtgttagccgacggtttaattgaagccagcaaacagaaaccgcagtttattgtcgattgtgcgaccttaacaggcgcagccaaagtggcagtgggcaatgactaccattcagtgctatcaatggacgatcaattagttgcccgtttatttgaggcagccaaagccgaaaacgaacctttctggcgtttaccgtttgaagagttccaccgtgctcaaatttcatcttcctttgcagatattgccaatatcggttctgtttctgttggtgcaggcgcaagtaccgcaacagccttcttatcctattttgtggaaaattatcagcaaaattggttacacattgactgttctgcaaccttccgcaaaactgcaagtgatttatgggcagcaggtgcaacggggattggggtgaaaaccttggggaatttattactctcctctcacgagtaatgggaaagataagttgggcattaatgcccaactttatcaagtatggagggaactatgcacctaagtaaatttactgattatgcttttcgtgtattgatgtatcttgctcatcatcaagatgagcttcgcaccattccgcagttagcagaatcgcttcaagtgtcgcagaaccatttggtgaaagtggtgcattttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacgcccttgaacatttctatcaatatttgaatcaatattcaatttcagaatgtattggctctcaaaagttgattaaaggtattctatgcgggaatactacgtcagatggctattgagcagaatatacattatctaaaatacatagagacacattttgtgcctctatagttatttattcagattgtgctgttgactcggtttcatcatccttcggctgataaaaacgagcaaccagtagtcctagttcaaataacagacacatcggcacagctagtaatgtttgagagaacatatctggtggggtaaataacattccgatcacgaaagctgccacaataatgtaaggacgcttctctttgagatcttctgctgtggttacgccagaccaacaaagtaaaatgatcgcaactggcacttcaaaacagacaccaaaggctaaaaagatagtcaaaatgaaatcaagatagctattaatatctgttgccattacaacaccttcaggggctgtttgggtcaggaagccaaaaatgagcggaaagactacataatacgcaaatgccacaccaatatagaaaagcagagagcttgagattaacagtggataaactagctttttttcgtgtttatataatgcaggtgcgataaatgcccagacttgatacaaaatataaggcacggaaataaatactgcaacaatcgccgttaattttatcggggtgaaaaacggtgtaaccacattcgtggcaatcatcgttgccccttcgggtaaacgttcagtaagtgggctagaaagtaatgtatagatgtcatttgcccaataaacaaggatacaaaaaataactaaaatacaaataaccgctcttaacaagcggttacgaagctcaattaaatggctaataaggggttgagattcttcgactgacattatttatcctgtttcgttttaggctcaacacttgcaagatcgtcatctgggggataatacgccgtcaatttatcctcgtctgcttcagcaagttctgcaatgcgatccgccgaaagcgtttcggtttcaagcggtgggttttcggtttctttttgctgttcagcttgttgagaaagttgctggctctcttgctcaattttattttgaatttcattaacttgctcttgcgtcagactttcaatttgccctctcgctgagtctaagttagcttgcattttctgtgcagattgtttgagttcttctacggttttgctcaattcaggagataaattacttaaattcaactcttctgctttcttaatgctctcttgcaactcttgcagttttagctcttgagaaagctcattttgaacgttagctgccaatcctcgaatagtgcgaacccagcccatcactgtacgaatagcaataggcaggcgtttcgggcctaataccactaagcctacgataaataccaaaactaattcagaaaaacctatatcaaacacggattatgcctgctctttttctttagctttttgttcagtaggttctgcggttttttgttctactttctcaaattcagcgtctttagctttgtcgtcattcatcgcttttttaaagcctttgatagattcgcctaagtctgagcctaatccacgtaattttttagtgccaaataataagacaactaataaaacgataatgactagattccaaatgctaataccacccattgtgtgtacctcttgtaagaataaaaaaataaaaacgtcgtaattatacgagttttcttgctaaatgacacttattttgtcggatttcgtaagaataaaaaagaagtaattcttcaaaatgtggcgttcatcacattattttgctttaatattagtaagaaaatcctaagtttgtttgatttgtgagcatttgtttgcaagaagccgtactttttagtaaatctctaaaaaaatccaaccgctatcttgtaaaaggcgttggatagtttgttatcctatattaaaatgtctaattttccatagtgggctattccacttcactttaaccacagagaacttaaaatgaactcaaaccgtagtttactgattatgggtttgttgcttgtttcgttcttgatttttacgcaatggcaacaggattataaccctgagatccaagcacaaaaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgagatccaagcacaaaaacaagcgatggctcaagctcaaacacaacaagttgcaaatcaatcgagtgatgtacccgcttcatctaatgcggcatctatcaatgagcaatcaactaaaggaaaaaccattactattgaaacggacgtgttacgtttaaccgttgatactttaggtggtgatgtggttgattctgatctcttaaaatataacgcagaattagactctaatacaccatttgaattgctacaagataatggcaaagtgctgtatgtggcacaaagtgggttagttggtaaaaacgggattgataccacagcaggtcgcgctcagtatcaagctacagcagagaaatttgcgttagcagaaggtcaagacgaaattgccgtgccattaacatttgaaaaagatggtgtagtttataccaaaacatttaccctaaaacgtggtagctataatgtggcggtaaattatcacatcaaaaatggtgctgcagaaactctcgaagttcagccttacggtcagcttaaacatactttagttgaaagtgccggcaattttgcaatgccgacctatacggggggggcttattcatcttctgaagtgaactataaaaaatatagttttgatgaaatggcaaaagctaacttatctgtactaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagctaacttatctgtagatactaaagcaggctgggcagcggttttacagcattatttcgtatcagcgtggatcccaaatcaagatgcggaaaataatctttatactcgcacaggaaatggcgtaggcactatcggttatcgtggacccgtaacacaagttgcacctaacggtgaagcaactattacaagccatttatggactggaccgaaagatcaagcagcaatggcacaagtggcaaataactttgatttaaccgtcgattatggctgggcgtggttcattgcaaaaccgttattctggttattaacattcattcaaagtattgtgtctaactggggcttagctattatcggtgtaaccattgtggtgaaaaccattctatacccattaaccaaagctcaatatacctcaatggcgaaaatgcgtatgttacaacctcgcattcaagagatgcgtgaacgtttcggtgacgaccgtcagcgtatgagccaagagatgatgaaactgtataaagaagaaaaagtaaacccaatgggcggttgtttaccaattcttcttcaaatgccaattttcatcgcattatactggacatttatggaagcggtggaattacgccacgcaccattcttcggttggattcaagatttatcggcacaagatccatactacattttccctctattaatgggtggttcaatgtacttgttacaaaaaatgtcgccgaccccaattgctgatccagtacaacaaaaagtgatgaactttatgcctgtgatgtttactgtatttttcttatggttcccatcaggcttagtactttactggctaacgtctaacttaattacgattgcacaacagtggttgatttatcgtaacttagagaagaaaggtttacacactcgtgttaaaaagtaattttataacatgggaacaaagaattgttcctatgttgtatttaaacctcatgatatgaatattcaattaattaatgaaagtgattttactgagcgcttttatgatatttgtgaaaaatggaaattgaagcataatcctagctctaatttagcattagtacagactaatgaacgccttgaattaaggaaacttaatcagcctaaattaggtgctgtagctgtaaattttgttgatggaaaaatgtcgtatcgtcgaaagtttggcggtggtcgtaatgaggctattgtgaaagctgttggtgttaagggttcgtacactcctacaattattgatgcgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacagcaggtttagggcaagatgcttttgttttggcatcaataggttgctatgtgaaacttattgaacgtaatccaattgttggcgcattattggaagatggtttacaaagagcttataaagatttagaaattggtcattttatgagagaaagaatggtattacttcctcatagttctattactggtttaaatccagatcttgactcggtggatgttgtttatcttgatcctatgtatccgtctaagactaaaagtgcattagtaaaaaaggagatgcaactatttcaacaattggttggctgtgatttagattcagatgatttacttttccctgctcagcaacttgctagaaagagagtggttgtaaaaagacctaactatgcattatttttagcaaataagaaacctgatttttgtaaggaaactaaaaaacatcggtttgatatatatctatctcattagaataaaatgatattttctacactaacttaataggagatttattatgaaaagatttatcgtagtagctttgttatcaagttctgctttagctgcgcctgtaggtgaaacttttacaggtgggggaattggtatggatgttacaactacaaaatataaaaatggtgatttgcaaggtaagcaggcaataggcataaactttactttagactatgcaacagattatggtaggaatttaattggaataattgatggtaaagcaaaattaggaagtagcaatatttttcatgatatcaaacaaaaatcccaatatagtattggatatgctcaaggataccgtctcctaccagatatattaccatacgttaaattaaattatagtattagtaaaatatcggattttggtagtttcaaagggattggatatgcgattggtataaaatatgcaatctctaacgatattgaagtaggtttagaatactcagaaaataatttgaaacgaaatggtacaaaattaaagggaaatgctattggaaccaatctgtcctatcgtttctaaatatttaagttgtacaagtaagttacctgtgaattggtgatatgaaattgataccataaggattagatctatttgagtggatctaatcctttttgttatctaatagcatatttgtatgatattttgtaaatatgtccgtgaaaatataaacaacctctgtttttaaaataaacatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactgaaacatctaagtaccccgaggaaaagaaatcaaccgagattttgtcagtagcggcgagcgaaagcgaaagagccagcaagtgatagcagcaaagacagaagaattggctgggaagccaagcgacacagggtgatagccccgtattttaagtttatgttgtggtactaaacttgcaacaagtagggcgggacacgagaaatcctgtttgaagatggggggaccatcctccaaggctaaatactcctgattgaccgatagtgaaccagtactgtgaaggaaaggcgaaaagaaccccagtgaggggagtgaaatagaacctgaaaccgtgtacgtacaagcagtgggagcccgaaagggtgactgcgtaccttttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttccgccacttatttataagcgagtaaattactcgctttaactatatgtaaataattatataggggcgtagttcaattggtagagcaccggtctccaaaaccgggtgttgggagttcgagcctctccgcccctgccatgtttcaaataaaccgattagttttgctaatcggttttttcatttcagtcgaccttccaaggtatttttatgttagaattttgcagatttttacgataattttatcgttattatgaaaccacttgatcctattattgaacaatttcttgatactctatggcaagagcagggattatcagaaaatactgtagcctcttatagactagatttagaaagttttacccaatggctttctgaacccaatgcatttttaaaagtagactatgttgatctacaaacctttttgggcgaaagactggagcaaggctataaagcaacgagttcatctcgtatgttgagctgtttgcgcaagttttttcgtttcctttatttggaaaagtatcgagatgatgatccaacagcaacacttacatctccgcgtaaaccagcccatttacctaaatcattgagtgaagagcaggtactggatttactgaatattccaaatactcaggatcctttagaattgcgtgataaagcaatgttagaactactttatgccacaggtttacgtgtcacagaactcgtttctctaacactggataacttaagcctgcgtcaagggttagttcgtatcattggtaaaggtgataaagagcgtttagtgcctttaggagaagaagcgagttattggatccaacagttttttgagtatgggcgaagttcactgcttaatggtatgcagtcagatgtggtttttcctagccgtttaggcaatcaaatgacccgtcaaactttttggcatcgaattaagcattatgcgttgttggcgggtattgatagcaataaactttctccgcacgttttacgccacgcgtttgcaacacatttagttaatcacggtgcagatttacgggttgtgcagatgttacttggacatagtgatctgtctacgacacaaatttatacccaagtagcgaaagctcgtttaaaatcactgcatcaacaatttcacccaagaggataatatgcaacaaggtttttcaaaatttagttgggcattggcatttttttgtttacccagttcattatggccattagcattgcttgtatcgcctgcattaagcgaaaatcctaaccttagcccaagtcaaattgattggttttctaccgcattttggatttatcctttcattttattggctattgctggcttgctgcataaattacatcaaaagcaaccgctagtagcaaagataggattattgatgggctatatctctttctacgacctaatttactatattatccgcaccctttaatgaaaaatattcattagcagccactttgtctactataccctttgaatatttattgtatccatacggttagaaatcaaattacagttgtactgaaaggctatgtggctctttatacctttgataattcaactgcaaccactgtaatccaacaacggcaattacattatcaatttttccttcaacaacccattgatatgcttgctcacggctcacaacgtggacaagaatatcttcgccttcttcttccaagccgtaaacaccgccgacttgggtgctatcaactaagcctaaaaagagatgtaaacgctcaactgcaccgcctgggctgtcccaaatgcttaaggcgtgttccacattgctgacggttaaacctgcttcttcgtaactttcacggatagcaacatcttctggcgtttccccgtcatctaccattcctgcaatcagttccactaaccaaggggattggttgctggttggatcgtaagcaccaatgcggacttgttcgactaacactacggcgtctttgacaggatcataggcaattaatgcggctgctgagcctttaatcattaattcacgcacaatttcaccgctcattccaccattaaataacttgtggcggaaatacatttttttcattgtgaagtgaccttgataaaccacttcttcttttaagatctctaaatctttttgctgaaattgctgaatttgtgtcataaaaattccttagcttttatgtaagcgttttgaatgaacaatatataaagcaacgatcatcactaaaatagctaatgcaaataataatgtgtgcattgcattagagtgatctacgataattaaacgtaccattgcggtaatgccgatatataaaaaatagcgtaatggaaaatggtagttatatttaaaatattgaacaatgagagctagaaattcaaaatataagaagaaaatcacaattttttctacaatttgaaatttatcactatggctaaaaaataattcaattaatgaatatgcttcatagaaaagagagtaagccagaattagtcctatcactaagagtgaaagatttaatatccattgaaaactctcagaaataaatcttccgaaacgagaatgttgttcttctaaattaaatttattcatactatccttaatttacttgatagataattgggttaagataatcaaatgaaatatatttcccattcttccattggctcagttttggtaatgataacatagtctgagtatgttcaaaaaaataagccaaataaaatggaagttgatgataaaagcagagtttccctgttgggctataggcggttgtgatctgctgtttacttaatgagtggattacttccgacagttttataattccagcaccctgtgatttaagcaccgcttctcgcaaacaccaacttaagtaaaaacggctttcaagggaagagagttccgataatagatgatgattatttatttcagctatttcttgctcactggcataataatgtaataaatcgttaaaacgacgtattttttgtgggtgttcaatatcaatacccaccacttttttcggggattgataagagaaaataatcgcaacccaatcgcccgaatggctaatattaaaatcaatctcgctatgttcaatataagggcgcccactttctgttttaacgatattagttaataaacttttatctaaatgatatttttcaaataattgatgtaacaggaaataagccatacggcgacttttccatttttttatttgataagctgacggcttatcaagagatttgtttatattccccaaataatttaaaaaatctgaagggataaattcatcatttggagcaaaaacaatttcaatagtattcatagctgtcattatagaagaaaaacccgataactatatttgttatcgggttttattgagtatagaattagcaatttaaaagctaaatcaaaaattatttgatttctactttcgcaccagcttcttctaattctttcttaagtgcttcagcttcacctttagagatgccttcttttaatgctgctggagcagattcaactaagtctttagcttctttcaagcctaagcctgttgcaccacgtactgctttgattactgctaccttgttagcacctgcatctgcaaggataacatcgaattcagttttctcttcagctgcttctgctgggcctgctgctactgctactgctgccgctgctgctgatacaccaaatttttcttccatcgctgtgattaattcaacgatttctgatactgatttagaagcaatcgcttcaatgatttgttcgttagttaatgacataacaatcaattcctaaagtaaataagttaaacgagttgagaatacggcgagtaaaaattatgccgcttcttgtaatttgtcgcgtaatgccgcaagagtgcgaacaagtttgcctgccgcagcttctttcattgtgcccattaaacgtgcaattgcttcttcgtaagttggtaatgttgccaagaattcaacatcttggattttaccttcaaaggctgcacctttaacttcaaactctttgtttgcttttgcaaaatctttgaacaaacgtgctgctgcacctgggtgttcgttagagaatgcaataagagttggaccagtaaacgtatcttttaagcactcaaattcagtaccttcaaccgcacgacgtaataaagtattacgaacaacacgcattgaaacgcctgcttcacgagctgctttacgtaactcagtcattttctctactgttacgccacgagaatccgcaacaacagcagaaagggcacctttggcagcttcgtttacttcagcaacaattgcttgtttgtcttgaagatttaatgccattggttttagctcctgatacactccacataaatactgtggaatttacaaaaaatctcaaaaaagtaaccgcttgagcgacgtttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggctaaggtgtacagaagcagataattctgtctgttcaccatctacgtaggttgttttcattaagaaactgttcacacaggttcacctacggtcttggatggggcttgagataaggctcagcaccatcatttactatccattatggagtagcaattttgcaattctacccttaaatttttaggctgtaaactaaaaattcatgcgaatatctggtatctgcttgttttacgtatctcattattcattcactaaactacattgacactaccctctttaaaatcttgatcatatgtaaacacactttcctcatcgattaccttagagactttaaaactatttctggcacaaactgccccacatctccctgatggcgataaatttctcttaccattgtcgaagaaagataacgccactctacggctgggggtaaaaaaatcgtttctaactgccctgctaatttttgatttaactgtgccagttgaatttcatactcaatgtcgtccgcccctcgaatacctcgaataagcgtggtggcattatgctgtttagcaaaatcgaccaacaacccactaaagccgatcacctcaacattattcagcatttgacagctttgctgtaccaactcaacacgctgttcaaggctaaatagcggttgctttgagggattttttgccacagccacaatcactttgccaaacaatcggctactgcgttgaataatatctaaatgcccatttgttatcggatcaaatgtgccagcataaattacagtttggttcattctatttctctaaataaggggctaacagttgaagatgacgagttaaagcaccttgattttcttgtaatacactcacccctgcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacactcacccctgcttgactaattttttgtccaagttcaggcttttcaaaaaagtaattgacggcatcaacaatcgaagtgacatcactttgaatttcaatcacgccccgaacctctcttaatttagcaaaaatctcagggaaattaaaagtatgtacaccagaaatcacgggaagttcaaatgcaattggctctaacggattatgcccaccgtgtttgactaaacttccgcccacaaaagcgacctgagccaagccataaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacctgagccaagccataaaacagcatcatctctcccattgtattgcctaacagtaccgacgttcctgcacttaaaagttcaaaagaagagcgtgttacatagggcattcccatattttttagtaaattttccacactatcaaaccgctcagggtggcgaggaacaaggatcagaactaaatcaggatattgctttaataactgctgatgtgcttccaacaacatcttttcctcaccttcgtgagtgctacctgcaacccaaatcggacggtcaagtaaatgtagctcaacggctgtttgagttaccttctggcgtaattgaggtgaaatttctaaatcaaatttaagattgcctgtattgactaaatgttcagcattaaatcctagtcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactcacctgatcttgagccaagataaaatcaatttcactcaacatctcttgcaaacaaggcttaatccaaccataacgttttgctgaacgaggcgaaagacgagcattggcaatcacaaagggaatttggcgttgatgggtttgatgaattaaattcggccaaagttccgtttcaatcacaatcaataactttggttcaacaaagtctaaaaaacgtttcaccgcatcgggcaaatcatagggtaaataaagatggtgaacacgattgccaaatgctgctttaacacgatctgaccccgttggggttactgtcgtcaccgtaacagacaactgaggataattcgctaaaatcgctttaatcaaaggagtagctgcaatcacttctcccacagaagcggcgtgaataacaatgccatttgcttgaggcttgatttcacccgatgaataaaaaccgtatcgttccttcaaacatttacgacgcttaggtagagaatgttctttctgccatatgataagagaaataataggtagtactaaataacctagaatagtataaattatacgtagcattatttactcctactcaaactccaactcaacggcattttcgcctaaaaaatcttttaatttctgcagcatcgtctcttttggggtaacacgccactcaacgccactacgcaataatacacgcccttctgggctttgataatagaaatgtaacggtaatgttccctctttataaggctcaataatagcggtcagatctttgataaattttgctgagagctgttcttgtttgatcgctagagctaaacttcttgcataacggctacgagcttcatcaagagtaatcatttcgcgaaccgccatttttaagccaccactgaaatcatcgtgttgcacagcccctgttgcgataataatctgatctttttgcaacagatcgccatagttttccagtgcttctgaaaaaagggtgagatccattttacctgaacgatcttcaatcgttgcaatcccaatacgactaccctttttggttgtcgcaattcttgcccccataattaatccagcaacggtagtagtttgtcctcgataggttggttgaacttcatttaatttattcggtgcataatgagctaactctttcaaaaaacgtccaacagggtgtccacttagatataaacctaaggtggctttttcgttatctaaaatggtctgctccgtccattttggcgtgttggcataggcgttctgaacttcttcgggggtttcagtcagcacgccaaacatatcactctgtccaagtgcttccattttattatgttgatcggacgctctaagggcatcttctaaatttttcatcaacgccgcacggtgaggccctagtttatcgaaagccccagccataattaatccttcaaatgtgcgacgattaacttttcttaaatcaacacgagcggttagatcgaatagatctttgaaaatcccgtctttattgcgagcttctaacatcgcatcaatcgggccttcgcctacgcctttgattgcccctaaaccatagacaatttcgcctttttcattgacactaaaacggtgtttaccgctgttaatatcaggcggaacaacggttaatcccatattgatacattcatcataaaagccgacgattttatcggtgttatccatctctgaagtcatcaccgccgccataaactccgctgggtaatgggttttgagccacaaggtttgataggataccaacgcataagccgccgagtgcgatttattaaagccgtagcctgcgaatttttctaccaagtcgaagattttcatcgccaactcgccatcaattccctgcttcttcgccccttcttcaaaggttgcccgttgagccgccatctcttcgggctttttcttacccatcgcacgacgcaataaatccgcaccaccgagcgtatagccagccaacacctgtgcaatctgcattacttgctcttgataaacgataatgccataggttggctctaaaatcggctgcagcgactcgtgctgatactgggcatcaggataggcaatcggctctttgccgtgtttacggtcaataaagttctgcaccattcccgactcaagcggacctggacggaataaggctaccaacgcaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatcagatctttcataccccgtgactctagctggaataccgccgtggttttggctgcttttaataatttaaaggctttttcatcgtcaaggggaatactttcaatccgaaccagtggcttaccttctttttccaagcgctgattgatcatctctaacgcccatttgatgatcgtcagcgtgcgtaagcccaaaaagtcaaatttaaccaagcctgcatactccacatcatttttatcgaagtgggtcacagggtgtaaaccgtaagagtcgaagtaaagtggcgaaaaatcagtaatcgccgttggggcaatcaccacgccccctgcgtgtttacctgcattacgtgttaccccttcgagcttacgagccatatcaatcaaggctttcacttcttcatcagtatcataaagctcaggcaatttgggctcggcttcaaaggcttttgccaacgtcataccagggtcaggggggatcaatttagaaatacgatccacaaaactataagggtgtccaagcacacgccccacatctcgaataaccgcttttgccgccatagtaccaaaggtaataatctgcgacaccgcttggcaaccataggtttccgacacgtgttcaatcacacgatctcgcccgtccatacagaaatccacatcaaaatcgggcatcgaaacccgttctggatttaagaaacgttcaaagagtaagtcaaattcaaggggatctagatcggtaattttcaacgcataagcaaccaaagatcctgctccagaaccacgccctggtccaacaggaatatcgttatctttcgaccactgaataaattccatcacaattaaaaagtagccgggaaagcccatttggttgatcacgtccaactcgacttgcaatctttcatcataaacagaccgtttgcttgcccgcacttcaggatcaggaaacaaaaataccagacgcttttccaaaccttctttggcttttttgactaaaaaatcttcagtggaaagatcgcccgtcgggaaattcggtaagaaatattcccctaaacgaatggtgacattacaacgttgagcaatgaataaggtattttcaatcgcttgtggcaaatcggcaaacaactgacacatttcgtcttctgaacggaagtattgctgttccgaatatttttgtgggcgtttaggatcgtccaacgtaaagctgtcgtgaatggcaacacggatttcgtgggcttcaaaatcgtcctgttttaaaaacatcacatcattgacagccaccaacggaattgcaaatttttgcgaaaaagtgaccgcttgttgaatataacgttcttcatcacttcttcctgttcgacaaagggaaagataataatgattgtggaaataacgttgataaaaagccaaaagctgttcggcttcttgctgattttctttcaataatgccttacctacatcgccattgctaccgcccgaaagcaaaatcacgccttcattatgttctgccagccacgctttttccaccacaggaaattccacatagccctgttgataagcctttgaaagtaaaagggtaatgttatgataaccggtattatttttggctaaaagggtaagttcgtataactcttcactctcaggttcagggcgaaccatcacatctgccccaacaatcggcttcacccgatcctaaggcttcgccgtaaaaacgcaccaagccacagaagttagtaaaatcggtcaatgccattgcgaccatattattggcaacacaggctttgattaacggcttcacttttgccaagccattaatcattgagaaatcactgtgtactttcagatgaacaaaacgaggttgggacataatggttattttctatttatattaaatgactttccaatgcattgtcgaatgtaagctatctttattcaccacaaacggatgagcatcgactgccttcaataacatctttaatttttgttttaattttgcaggatcgatcggctgagggaataaacgtgaattacttcttttttgctctaaatgtaatactatctttatcttatttttcttcaaaaactgtttagcaaactgctgttcgctttgattattcgcatttaatttcatcgcaacaattccagccaaggtatctctaactttaattgctatttcatcggctaatggtattgttttcgttctctgatattgtcgataatcttttacttcaatcatccagttatcattttcatcaaccacaataatatctactgctttggttccatttgcaaaagcattaaattgattacgataaaaagataaatcatcatatttttcaacaagaataaactcgttaaaaataaacgttaaatcaccttctttaattacaatctctgacatttattctaccaatgctaaaaatctatcggattgttcaagctcttcgtctaataatgttaaaacttccaattgattaatactatcaccttgatcaactacaataccattatctatcgtttttaaaccgaaataaaattgttttaaatgagcaaattcttgtcgtttagaaagtatttctagttctcttaacaaaaaaagtgaatgagttgcaataaaaatttggataccgttattacataattgcaaaataaccttagcgactgttttaataagtttaggatttaaatttgcctctggttcatcccaaaataacgcacctttacctaacaaagatcctgttgcaattaatctcgcaatcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattaatctcgcaatcatcgctaattttcttaatccctcagcaaccaaaggaatttccatagttccttgtccctgaatagaaagataaaaacgcccattatctaaaaccgttttcccccccattgcctcttctaatggttttaatagctcttttgcacgctcctctctaggacctttggctaaataatttcctaataataaacaagtgtcataatatgtttcctcatactctaaataatgattattataagtatgaacaaaattaggataaatcgttaataattctcttgtaggtaaaaaaacaggattattctctattttacttttaggtaatatatctatttgaacttcggatttacttgatgtcgcaaaactaaattgacaattataaaagtcattttcaaatttagctgaaatttcacaacgctctctcccttgtttacggcgaacaagtcggcctaaactttcaggtctaaatacattaattaatttatctgcataattcttttgcatttgcgttttacttacagaaaaagcagaagcattacaagcaatgagagaatacgctaattttaaaatgtgcgattttcccattccattttcccctataataacatttaaatggggagaaaaatttaaatcaacttcgttaaatactgtgaaattctttaatactaatttatttaacatagtctttccttaatttaatcccttttcttattcaacaaccaccacaccacacttaaacagagcaaacttgggattaatgcccctattggtacgggtagccacgaaacaataagacttaaattaccaaagacgatattcgccacataaaatacaaagcctgcgagaataccgatcacaatttttgcccccatcgtactactgcgtagcggaccaaaaataaaggaaatcgcaagcaacatcatcaccgccattgagatcggctgaaaaactttacgccagaacgtaatctcaaaacgttttggatcttgccctgtatcttttaaaaagcctacataatccgctaatcccgaaatagacaacgactctggcttcaaggacacgatccctaacttgctcggcgtaatgcttgttttccacgcctgatctgtttctctggtctgggttattccgctttcgtgaatttctgatttatccacctgctgtaaaagccagccttgttccgaataggtcgctttttccgcctgtttgatggattttaaaacctgattttcaaattggtaaattaaaatattatttaagttacgttcatcttgaatttgacgaatatagataaaatcattgccatctttcgcccaaaatccgccttgggtcgccagcattgaaccgccactttgagcaatagatcgcatatttcgggcatattgttccgtttgcggtacgccccattcccccataatcatcgtaatcaccattaatggaattgccgttttcatcaccgccagcccaatgcggaagcgagaaaatccagccgattgcattaccactaactcactacggctcgccaaaccgcccagccccattaatgaaccaagcaacgctgcgattgggaaaaaggtttcaatatcacgaggcatcgtcaatagggtgtaatatgctgcgtgtaagccatcgtagctccctcgaccaacggaacggaactcttcgacaaatttaataattgccccaagccctactaacataaatagggtaagcataatggaagcaagaatggttctgccgatataacgctctaatacattcatttacttgccacctttttacttgaaaaacgataacgcaatgccgaaaaccatttactttcccagctatttaaaagagtgccaagcactaaaaatgccacagacaccattggcattaacaaagacacatttagcttacccgaagcccctgccgattttaacgaactctgtaataagaaatagattaaatacaacaataacgcaggtaataattttgcaaaacgcccttgccgtgggtttacactactcatcggcacagccagcaacgccatcaatggcacagataaaatcaacgctaaacgccactgcaactctgcctgagcttctggggaagtttcagcaagcaacttctgaaaatcggcacgttgaaccaatttttcatcactatcaacatcttgatagccgagataggcattgtaattatcaaaatgcgaaatacggaaatccgccgtttgaggcgttccttcataacgagtactattggttaaatttaacatttgatcgccattcggaagcccttgtaattcccccgatttagccaccaccacagagggtttatttttcttttgctgttcaggctgaaaaacataaatatcattaatggtgttatctttaatgttatcaataaataacacatacccacctgcagacataaattgccctgcggctaatgcagcaaagcgaggatttgcttttgcttcagccaacatttcgctctgtttattaatcgcccaaggggtaagccaaaagacattataaaccgccactgccgtggtaaagatcgataaaaataacgctgctttcactaaaaggctctgccccaccccacaagcgcgcattaccgtaatttcactttcagcataaaaacgccctaaagtgagcaaaagagcaataaataacgacaaaggcaacatcaactgtgccattgtcggcatacctaatccgagcaagctcaatactaagtctgtagggactttgccactcacagccgagcttaatactcgtactaattgttggcagaagaagatcactaacagtatgaaaagtatagcaatttggcttttaaatatttctttcgttaaatatcgacttaaaatcacgacaaagttctcattttgacaatttatcgcttgcaattttcaagcaaacaggtagttttatgacccatattttaattgcaagttcaagcggttggatttgggtaaaattttgaatagcccacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccgtaaagctgcgtgtccataaaactatatatgtccgcaaatatgtgtttgagccagaaatatggacacacgcagtgtgtccctacctttctttatcattcaaacaaaggctaaataatattgtaaaattttaccaaaacccatcgcttgcaaaatgtgtgatcatacccttttatacaaaaaaaatcacgggagtattttatggaatttagcgttaaaaacggatctgttgaaaaacaacgtacaggctgtctggttgttggggtgtatgaaccccgtcgcttatcgcctgctgcggagcaattagataaattaagtgacggctatttaagcaatttattgcgtaaaggcgatttagaaggacgtgttgggcaaacgttattactacacaacgtacccaatgtcgccgcagaccgcgtgttgttagttggctgcggcaaagagcgtgaactgactgaacgccaatacaaacaaaccattcaaaaaatggtacaagtcattaacgacacaggctcaacggaagcaatctgcttcttaaccgaattacacgtcaaagcccgttccgtttactggaatatccgctttgcgattgaagctattcaagaaaacggctaccaatataacgaatttaagagcgtgaaacctgaaatccgccgtgaattacgcaaaatcgtatttaatatcgctaaccgcaaagatttaactgtggcagaacaagcggttgaacacggcaaagcgattgcatcaggcgtgatcttcgccaaaaatgtagcgaactgtccgccaaatgtctgcaacccgaaatatttatctgagttagccaaaggcttagccaaagagtacgataacatcaccaccacggtactggacgaaaaagagatggcggcattacaaatgaacgcctatcttgccgtttctcgtggttctgaaaatgatgcttatctttcaattatcgaatataaaggatcgccaaatcctgcagcaaaaccgattattcttgtcggcaaaggcttaacttttgacacaggtggcatttccattaagccgtccgatgcaatggacgaaatgaaatatgatatgggcggtgcggcttctgtctatggcacaatgaaagccattgcggaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaagccattgcggaaatgaaattgccattaaatgttatcggcgtactcgcaggctgtgaaaatatgccagacggcaacgcttatcgccctggtgatattctaaccacaatgtcaggcttaaccgttgaagtcctcaataccgatgcagaaggacgtttggtattatgtgacaccttaacctatgccgaacgtttcgatcctgaattagtgattgatgtggcaacactcacaggggcgtgtatgatcgcacttggcaaccacaatagcggattgatttcaccaaataacgcacttgcaaacgacttattaaatgctgcagaacaagcggatgataaagcatggcgtttaccaatgggagaagagtatcaagaacagcttaaatccaactttgccgatcttgccaatatcggcggacgtttaggcggagcgatcaccgcaggggtattcctatcgaacttcaccaaaaaatacacttgggcacacttagatattgcaggcactgcgtggaaatctggggctgccaaaggggcaacaggcagaccagtgccgttgttgagtcagtttttgattaataaagctggcgtctaacctgtttgcctcctaaatacaagcggtcagttaggctctaaaatttgcaaattttgagtcgaaactgaccgcttgtaatggcagaattttcactaaacaaacatataattcttaacccaaaggcgttattccgttagaataacgcctttttacgttttccttcgggaaagtcctgacttgttatcagaaagagaatccacatgttacgacataaaccagaacttttatcaccagcaggcacgctgaaaaatatgcgttatgcttttgcttatggagcagatgccgtttacgcagggcaaccacgttacagcttgcgtgttcgcaataacgaatttaaccacgctaatttgaaaatcggtattgatgaagctcacgcacttggcaaaaaattctatgtggtagtcaatatcgccccgcataattccaaactcaaaacctttattaaagatctgcaagttgttgtagatatgaagcccgatgcgttgattatgtctgatccaggcttgattatgttggtgcgtgaacatttccctgaaatggatattcatctttccgtgcaagccaacgcagtaaactgggcaacggtaaaattctggaaacagatgggattaacccgtgtcattctttctcgtgaactttccattgatgaaatcgcagaaatccgtgagcaagtgcctgatatggaaattgagattttcgtccacggggcattatgtatggcatattcaggacgttgcttattatctggctatatcaacaaacgtgatccaaaccaaggcacttgtaccaacgcttgtcgctgggaatatcaggtggaagaaggtaaggtagatgatgttggcaatatcgtgtcaaaaattgatccagaacagcagattgaaattaaaaatgtcgcaccaaccttaggcgaaggcgataccactagcaaagttttcctgcttgccgaatcgcaaaaaccggatgagcaaatgaccgcttttgaagatgaacacggcacttacattatgaactcgaaagatttgcgtgcggtgcaacacgttgagaaactgacccaaatcggcgtacattccttaaaaattgaaggtcgaactaagtcattctactattgtgcaagaactgctcaagtttaccgcaaggcgattgatgatgcggcagcaggcaagccttttgatgaaagtttaatggataccctagaatccttggcacaccgtggttatacggaaggtttcttacgtcgccatacccacgatgaataccaaaattacgattacggctattcgatttcagaacgtcagcagtttgtcggcgaatttaccggcaaacgcaatacagaaggtatggcggaagtcgccgtgaaaaataaattcttacttggcgatgaagtcgaaatgatgaccccaaaaggcaatatcgtgttcaaaatcgaacgaatgttaaaccgcaaaaatgaagctgttgatgctggcttaggcgatgggcattttgtctttttagatgtaccagccgatgtggaattagattatgctttgttaatgcgtaatttggttgatgcgaatactcgaaatccgcataatttataaaagataaccttaatcttattactacttagcggaagtatgtacagaataactaaagcaattgaactgataagcggaagaaggtctagagccaaatcttaccgcttatttttaggagataaaatgaaaaaaacgctctcttttagccttattgcccttgctttaggcttaacggcttgtaccacgaaaacctaccaaagcaccttaaccgaaggggtggataacagcgttgccccacaacaagatttttatcgctatgtgaatggtaagtggctggataccgcccaaatcccgtctgatcgtacttcttggggaaccttagcagaactcaatgaattgaacgaaaaacgttctgttgagctgttacaagcggtcatttcagacccaaattttgcaaatgatgaaaaagcacaacgtttaaaagcactgtatcaaagttataccgatttgcctgctcgtgaaaagcttggtttaagcccaattcaagctgatttaagccgaattgatcagataaaaacctttgccgagttagagcaatatttaattaatgaaaccaagcaaggcaatgagatgttatttggttggtcggtgtttgcccacctgaaaaactctcgccaaaacgcaatctatttcagtaatgatagccttggtttgagcaacgattattatcaaaaggatacccctgaaaatcgtaaaacattacagctttatcaagattatgttgcacagatgcttcattttgctcaggtaaaaaatccgaagcaaaaagcaaaagcgattgtggagtatgaaaaagcgattgcgaaaaccctatttaccaatgagcagcgtcgagatattcaaaaacgctataatcctttatctatcaatgaattagctaaagcgagtaaacatattaatcttgcaaattatctcaacgccgttggggtgaatacggaagaagttattgtgtgggagccgaatttcttaaaacagtttgatcagctaatcaacccacaaaatcttgcgttaattaaagattacctacgctttaaaaccgtttcaaatgcgtctacctatttaaacaaagccttagatgatacgaattttgctttttatggcaagcagttggtgggacagaaacagcaaagaccgttagataaacgtgcgttacgtttgattaacaaccaaattgggcaggaatttgctcaattttatgtggaaaaattcttccctgcgacagctaaaaaagacctgcttgaaatggctggttatttggttaaagcctaccatcagcgtatcgacaatttaagttggatgtcggcagaaaccaaagcaaaagcgaaagtgaagctagataaattcatcgttgaagtgggttatccaaacaaatggaaagattatagccaactgcatttaaaaaccgtagaacagggcggttcgctttatgctaacttgcgtgaaattgccaaatggaattaccaagaagccttaagtaaaatcggcaaacctgttgatttgaatgaatggggaatgttgccacaggtggtgaatgcttcttatagcccattgatgaaccgtattgtattcccggctgggatcttacaagcaccgctttacgatatgaacgccgatcctgctgttaattttggggctatcggagctattatcggacacgaaatcactcacggctttgacgacagcggttcaaaatttgatggtgatggcaacttaaaagagtggtggacagcagaagatcgacaaaaatttgaagcccttgcagatcaactagttgctcaatttgataaatttgaagtcgccccgaaaatttttgtcaatggacgtttcaccttaggggaaaacattgcggatctgggcggattaagtattgcttatgatgcattaaaacgttatgagcaagatcacggtgtgaccccaatcttggagaaccttaccccagatcaacgcttttttatgagctggacacgttcgtggcgaaataaagcgacggtccaagccttaacgcaccaagtgaaaagcgatccgcacgccccaggacaataccgtgcttttgcccctgtattaaatatttcgggcttccataatgcttttaatacaaagcaaggtgatgcaatgtaccgtccgattaatgagcggattaggatttggtaatatacaaatttcccatagaagagaggctgagtatataatcaaggaaaaattcataaattcccagtataatctatccacttatttaaactaaaaggaatacaaaatgcaaaacccaaaagatgatgtactttatgcccctgttgaatggtccgattgcagcgaaggttatacggatattctgtatcataaatcgactgacggtatcgctaaaatcacaattaaccgtcctgaagtgcgtaatgcgttccgtccgcaaacggtaaaagagatgatccaagctttctctgatgcgcgttttgatgaaaaaatcggtgtgattgttttaacgggtcaaggcgaaaaagcgttctgttctggtggcgaccaaaaagtgcgtggcgattacggcggttataaagacgaaagtggtgtacatcacttaaacgtattggatttccaacgtgatattcgtagctgcccgaagcctgtggtggcaatggtcgctggttatgccattggtggcggtcacgttttacatatgctctgtgatttaaccattgccgcagaaaatgcgattttcggtcaaaccggcccgaaagtgggttcattcgatggcggttggggtgcaagctatatggcgcgtattgttgggcagaaaaaagcacgtgagatttggttcttatgccgtcaatatgatgcgaaagaggctttagaaatgggcttggtgaataccgttgtgccttatgctgatttggaaaaagaaacggtgcgctggtgtcgtgaaatgttacgcaacagcccgattgcattacgttgcttaaaagcggcgttaaatgcagactgtgacggacaagctggcttgcaagaattagcaggtaatgcaacgatgttgttctatatgacgaaagaaggtcaagaaggtcgcaatgcgtttaatgaaaaacgtgcgcctgactttagcaagtttaagcgtaatccttagtatgtataaaatggtatagtagacaaagtggttgctaatgaatatttttaatggggctgacgtagattagctagtatgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgaccgcttataaaacacaagctcaagtatttacttgagcttgtatataaaaagcgtttactactcttttttcatttcagacgcaaacagataagcacctacaaagattctggttaaagtatctaataagtaagcctcactaataccctcctcaacatccagatcatctttcaaagcaagatcaccatctttatcaatataagcagttaaaaatctttttgttgcattccatttattgacacttttcaatgaagtattatcgccatcaaaatacatcctaaaagttaaagagccatcgtcacgttgattataaattaccagctttatcccagagtcgctggtaattctaatccttcctttttcaatcagctcaacttttggatattttttcttcacaatatcaatcaattgttgatcagaaaacttagtataaacttccaccattttggtttctgcataagctgttgtagaaacgagcgtagtggtaatcaacatggcaaaaaacattgatagaaaataagctggcgttttgaggtatttataaattttcataaacacccccaccattttctaactgacgaacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgatagagattgagagaaagtttatcccttgtttgagcggcaatatctgtttcgtaaagttgcttatcaacaggattgcttaaatcatattggtagtaggttccacttaatcctttataagcaaacataccgtttttcatctgttctttaatcataaatataccttcatagtaatgctaaatgttttggcagagatgattttagttcattacgcaagtaatgaattaaataatgctagcattattgaaaattttgattaaaaaatggtaataagcggtaagatataagaagaattttgaaaaaacaaaagcccgataaatctatcgggctttttaagtcaatgtagaattattctgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttgttcagctgcaacttcaggacgatcaactaactcaatgtaagccattggtgcgttgtcacctgcacggaaaccacattttaagatacgagtataaccacccgcacggtttgcaaaacgtggacctaattcattgaataatttagcaacggtttcgatgttgcgagtacgagcaaaagctaaacgacgattagcaacgctatctacttttgctaaagtaattaatggttcaactacacgacgtaattcttttgcttttggcaatgttgtcttgatgatttcgtgactaactaatgcacttgctaaattacggaacaacgcctgacgatggctgctgttacggtttagttgacgtccactcttacgatggcgcataaccttattccttctaagaaaatctaaacctaaaattagtcttcagcaatacttgctggaggccaattctcaaggcgcataccgagtgataagccacgagaagcgagaacatctttaatttcagtaagtgatttcttaccaagattaggtgtttttaataactcaacttctgtacgttgtactaaatcaccgatatagtgaattgtctctgctttcaaacagttagcagaacgaactgtcagctctaagtcatctactggacgaagaagaattggatcaaattccggtttctcttctttcacttctggctgacgaacatcacgcaaatcaacgaatgcagcgagttgctctgctaaaatcgttgcagcacggcggatggcttcttctggatctaatgttccgttagtttccatctcgataacgagcttatctaagtctgtgcgttgttcaacacgagcagcttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattgtaagcaatgcgatctaccgggctaaaacgtgcatcgactaataagcgaccgattggacgatcgtcgtcttgtgtatgtacacgagcagatgctggtacataaccacgaccacgttgtacacggatacgcatactaattgatgcgtttttatccgttaagttacaaataacgtgatctggattcacaatttcaacatcaccatcgtgagtaatgtctgctgcagttacagggccaatcccagatttagtgagtgtcaaaataatatcatctttattttgcacttttaccgctagacctttaaggtttaacaatacctcaagaatatcttcttgtacgccttctttgctgctgtattcgtgtaatacaccatcaatttctacttctgtaactgcacaaccaggcatagatgaaagtaaaatgcgacgaagtgcgttacctaaagtgtggccgaaaccacgttctaacggctctaaggtcacttttgcgtgagttgaactaatttgttcaatattcactaagtgtggctttaaaaattctgttacagaaccctgcattttatcctctctttgcttttaagcttaactattatttagagtaaagctcaacgatcagatgttcattaatatctgctgatagatcagaacgctcaggagtacgtttaaatacgccttccattttagttgcatcaacttctaaccaagttggtttttcacgttgagtagctaactctaatgatgctttgatacgtgcttgttttttagatttttcacgaacagcaatcacatcatcaacagaaacttggtatgaaggaatgtttacaacacgaccatttaccacgatagatttgtggcttactaactgacgtgcttcagcacgagtagctgcaaaacccatacggtaaacaacgttgtctaaacgaccttctaacaatactaataagttctcaccggtattgccttttaagcggttagcttctttatagtagttacggaactgacgttctaaaataccatagatacggcgaactttttgtttctcgcgtaactgactaccatagtcagataaacgaggcttacgagcaccgtgttgacctggtgctgtatcaattttacattttgactcgatcgcgcgaacacctgatttaaggaataaatcggtaccttcacgacggcttagcttgagttttggacccaaatatcttgccattttctttctccaattatcctaacgtcaattacacacgacgttttttcggtggacgacaaccgttatgtggaatcggagtcacatctgtaatgttcgtgatacggaaacccgctgcgtttaatgcacggattgttgattcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacggattgttgattcacgacctggacccggacctttaaccataacttctaaattctttaaaccaaactctttaaccatttctgcacaacgctctgcagcaacttgagcagcgaatggagttgatttacgagaaccacggaaacctgaaccacccgcagttgcccaagctagagcattaccttgacggtcagtaatggttacgattgtattattgaaagatgcgtggatatgagctacgccatctacgatctgtttttttacacgtttacgtgcacgaactggtgttttagccattatttatctactccgattattttttgatcggtttgcgtggacccttacgagtacgcgcattagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgttgaccacgtactggtaaactacgacgatgacgtaaaccacggtagcaacctaggtctaaaagacgtttgatgcttaaagttacttcacgacgtaaatcaccttcgacagtaaatttaccaacttcttcacgcagtttttcaatctgctcttcagacaattctctgatcttcacatcttcagcaatacccgttgcagcgcagatcgcttttgcacgagttttaccgatgccataaatagcagtcagtgcgattacggtgtgtttttgatcaggaatgttaatgcctgcaatacgggccactatgcactcctatttaactaaagttattgatatgctgatcttgaaaagcccgtttcaggatactcaaacagcatatcaggacgaaatgagctgagcagtataaccgctcagcaggttctttgcaagaaataatgtcaattaaccttgacgttgtttatgtttagggtcgctacaaattacgcgtacaacaccttcacgtttaacaactttgcagttacgacacattcttttaactgaagcacgaactttcattgcttatccttttgatctaagggcttattgccctaagcctttcaaattggctttcttcaacacagaatcatactgtaaagacattagatgactttgaacctgtgcgatgaaatccataataacaaccacaacgatcaataatgaagtaccgcctaattggaaagatactttccataatgatgttatgatataaggaaccaaacaaacaaaggtaatatataacgcaccaattaaggttaaacgtgtcattactttatcgatataacgagatgtttgctcgcctggtcgataacctggtacaaatgcacctgattttttcaaattatccgctgtatcacgaggattatattgcattcctgtataaaagaatgcaaagaagattacagccattgtaaataatacaatatagagtggctgacctggttgtaataactgtgataaatcaaataaccattcaaaaccttcgcttgttccgaaccattgtgcaatggttgctgggaataaaataatacttgaagcgaagattgctgggattacaccagccatatttactttcaacggcaaatgagattgtcttgcaggtgctatcattcttccctgctggcgacttgcatagtttacaacaattcttctttgtccacgttccacgaagacaacaaaatatgttacagcaaatgcaactacagctattagtaataacactaataatgaaatctcgccttggcgagattgttcaatagtttgcccgattactgatggaagatcagcaacaatccctgcaaaaataattaacgaaataccattaccaatgccacgctcagtgatttgctcacctaaccacatcaggaacatagtacctgttactaaactaattacagaagttacatagaacagcatatttggattaggaactaatccagctagcatattcggcagggctaatgaaataccaatagactgaataaatgctaataacaacgtagcataacgtgtatatttgctaattttacgacgccctgcttcgccttcttttttcaactcggcaagtgctgggtgtaccgctgtcaataattgaataatgattgacgctgaaatatagggcataatccctaacgcaaatatagaagctctacttaaagcaccaccagagaacatattgaacatatcaatgatggtgccttgctgttgtcgtactagctcggataatacagaagcatcaataccaggaacaggaataaaagaaccgatacggaaaacgattaaagcacctaaaacaaacaataatcgtgattttaattcaccagtccctttttgggtattaccttgatatcctggttgtttagccatttattattcctcgatagaaccaccagcagcttcgatagcagcttttgcacctttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacgcctaagcctttaatcactactgctttttcaactttacctgaaagaattacttttgcagataaaatatcttttgtgattacgtttgctgcttttaacgcatctaaagtaacaacattaccatctacttttgctaagtcacttaaacggatttcagctacgtgtaatgctttaagagaagtaaaaccaaattttggtaaacgacggtataaaggcatttgaccaccctcgaaaccacgacgaacaccgccgcctgtacgagatttttgacctttatgaccacgaccaccagttttacctaaaccagaaccaataccgcgacctaaacgttttgcactgtgtttagcaccttcagctggagaaagagaatttaaacgcattctattattcctccactttaaccatatatgaaacttgattgatcataccacgtactgctggagtatcttctaactctacggtatgacgaatatgacgaagacctaagcctttcaacgttgctttatgcttcggtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctttatgcttcggtaaacgagcgatagagctacgagtttgagttactttaatagttttagccatattcaattaccccaaaatttcttcaacggttttgccacgttttgcagcaaccatttctggtgatttcatatttgctagtgcatcaattgttgcacgaacaacgtttattgggttagttgaaccgtacgctttagaaagtacgttgtgaacacctgcaacttctaatactgcacgcattgcaccacctgcgatgatacctgtaccttcgctagctggttgcataaacacgcgtgaaccagtgtgagaacctttaacagggtgttgtaatgtaccttcgtttaacgctacattaaccatattgcgacgagctttttccatcgctttttggattgctgctggaacttcacgagctttaccgtaaccaaaacctacacgaccgttaccatcgcccaccactgttaaagcagtgaaactcataatacgaccaccttttacggttttagatacacggttaaccgcgattagcttttcctgcagttcaccagcttgtttttcgatgtttgacatctcaaattcctctattagaactgaagaccagcttcacgagcagcatctgctaatgattgcacacgaccgtggtatttgaaacctgaacggtcaaatgcaactgctttaatacctttttctaaagcacgttcagcaacgattttaccaacgactgctgccgcttctttattaccagtatatttaacttgctctttaattactttctcaacagttgaagctgctgctaaaacttctgagccattcggtgcaatcacctgcgcatagatatggcgaggtgtgcgatgcacaactaaacgtgttgcaccttgctctctcattaaatgacgtgcacggcttgcacgacggatacgagctactttcttatccatagtgttaccttactttactttttcttcgcttctttaatacgtacaacttcatcagcgtaacgtacacctttacctttataaggctctggtttgcggtatgcacgaatatcagctgccacttgaccgattaactgtttgtccgcagacttaagaataatctcagtttgtgatggacattcaccagttacacctgctggcaactcatgttcaaccgagtgtgagaaacctaaatttaatgcaacagtgttgcctttcatttgagctctgtaaccaacaccaactaattgcaatttcttagtaaagccttcagtaacaccgataaccattgcattaacgagggcacgagctgtacctgcttgcgcatctgcattaacgatacccgcttttggagcgaatgttaaagtatcagcttcgtattttacttcaactgcattgtgaatttcgcgagacaactcgccatttttaccttttactgttaatagctgaccattcaaagtaacttgaacgccggcaggaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttttggtaactcgtctttacgtttataaatacgaagacctggacggcttacgcgttggatactttctacaactggtttgttttggaaatattttaaagtgatttccaattcaggttttgaaccttcaacaactttgaagctctcaacataaccttcttcagctaaaacgcttgcaatagcaacttttaacttagatgaaggcatactgattgcaactttattcgcagcttgaccgttacgaatacgggtcagcatatctgcgattggatcttgcatgctcatgtatttactcccatgattccaaattaaaagaggttattaccagcttgctttcttaaggcctggaatttcaccgcgcattgcagcttcacgcaccttaatacggcttaaaccaagcttacgaagtacaccgtgtggacgaccagtttggcggcaacggttacgctgacggattggactagaatcgcgtggaagtgtttgtaattttaacactgctgcccaacgatcttcgtctgaagaatttacatcagaaataattttctttaactcttcacgtttagcgtagaatttatcagctaatttcgcacgttttacgtcacgtgcaatcattgattgttttgccacgataacctaccttatttacggaatgggaaattgaaagccgctaataaagcttgaccttcttcatcagttttcgctgtagtggtaatagtaatatctaaaccacgaacacgatctactttatcgtagtcgatttcagggaaaatgatttgttcacgaacacccatactgtaattaccacgaccgtcgaatgatttcgcgtttaaaccgcggaagtcacggatacgtggaacagcgatagtaatcaatctttcaaagaattcccacatacgttcaccacgtagggttactttgcatccgattggatatccctgacggattttaaagcctgcaacagatttgcgtgcttttgtaattaaaggtttttgaccgctgattgctgttaaatctgctactgcattgtctaacagttttttgtcggtcaatgcttcacccacacccatattcagggttatcttttcgattcgtgggacttgcatgacagatgagtagttgaattttgcttttaattcattaactactgtatctctgtagtaatcatgcagtttcgccatcgcattactccagttaattaaattgttttctcgttagatttgaagaaacggacttttttgccatcttcgaatctaaatcctacacggtcagctttatttgtttctgggttgaaaatcgcaacgtttgacgcatcaatcgcagcttctttcttcactaaaccgccagctttgcctaaagcaggaactggtttttcgtgtttagtgataatgttgataccctcaacaaccactttaccgtttggtaacactttagttaccttaccacgtttgcccttgtctttaccagcaagaacaattacttcatcgttttgacggatttttgcagccattacattctctccttatagtacttctggagctaaagaaatgatcttcataaacttctcagaacgaagttcacgcgtcacaggtccaaaaatacgagtaccgattggttgctcagtgttattgtttaaaattacacaagcattgccatcgaaacgaataactgcgccatctgggcgacgaacacccttcttggtgcgcacaacaactgcttttaacacatcaccttttttaactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcgtggaattgcttctttcacagtaactttgatgatatcgccgatagcagcgtaacgacggtgcgatccacctagaaccttgatacacattacgctacgagcccctgagttatcagcaacatccagcatagtctgttcttggatcatattagtgctccgttaaaataaaaaacaccctttcgggacgaacctatttaccctatgcaaataggttgcggattatatcgcaattagcgtaataagatcaactgaattttattagaatgcattagagagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagagagtaggagttctcctcattcactactttaaaaaagtattaggattaataatcattggcgcaactattttacatgaataaaaacaaccaaattttgtgacccatctctcaataacatcgcggaagactaggcatttttgatattctatgattaaaatgcacttatttattttatcgaagcaggctttatgaaagtatcttccattgctattttagtcagtttattgagtttaaattgttgggcgaatgatgaaattgttcgttcccaacaagaaaaccaacaccaattacaacaaatccaacaacatcaacaatctcgttgggtttcccaacatcaattccaaagccagactaaagcacaggataacagtacggcaaccgaacattattgcttacgttacaataggttacagataacgggtgtaactttaatcgatcccctttcatttcagccattgccctacgaatgtttaaatgaaaaccgccttaatcaacttagccgagatttaacgcaagcctatttggataagggctatattcacaatccatttcaatttgaagatgatggttcgaaaacgctgattttacgagtaaccgaaggcaaagtggctaaattgacggggggaagttcgcaagtaaacttagccatgctgtttcctaacattgtaggtcaaccattaaatatcaaagaattagatcaggggctagatcaagcgaatcgtttgagtagcaatcaagtttctgtcgatgtattacctgccaaaatggcgagatcgaactctcttttgtcaataatccctcgcctgctgtttccggttatattggtgtagataattttgcttcacgccaatatcatcgttggcaaagccgtttcgggttaaatgtagatagcccatttggactgtcagatagcctttatttgggcggaagccacacgttaaaatcgacaccggaatttaatcgctctgcaattttatattattccgtaccttatgggcgttggacctttaacagctttggttctgtttcgcaatttcgccgacaaattccgttggtttatcataatgtcgagcaaaaaggtcgaacgtggcaggctggggtggaagttgattatgttgctcatcgaggggcaaaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaccatatttccacaatttctgcacaagtagaacatctgaatagtaaaagtcgttttgaggacagtgtgatcgagttacaaagccctaaattgagcgttgcacaattctcttttaaccacttacagctactgtcgcaaggttcgttgatctttaaccttgattatcgtcggggattggcttggtggaatgcgattaaaaatcaaggacgagatcagcctgaagggcaattccaaaaatggagtggcgatgtacagttgagttactttcatttgttaggttcgcaaaaattccgccaatctcaccgcttgtttggtcagtatagttcaaattatttgccagccacagaacaagcggatttattaggacgatatgcagtaagaggcttccaagatttatcgctctcggcagaaaaaagccttgttatgcaaaatacgttaagttggttaaataactatcgatctttacaaatagagccttacgccttgtttgatctgggggtacagaaaaatagcagtgataacgctcatagccaacgtgctttcggctatggtgctggacttcagttagctaaaactacgtggaagtcggatattcaatgggttaaaggcaaaatgcaacgagaaaaaacacagatgtgggaaaaagaacaaagacggcaaattaaccgttcaggtggaagaggcaaaagatgttttagttcaagctggcaatgcaaatgttcaggggaaagtgaccgctagcacccactgtcaacataaccactacactgcagacaaaaacgttaaagtagaagagtaccgttccggcaaaaatgaaaaatatcaagcaaccaaaatccaagcggataatcttgttgtcgatgtggataaccgtttaaatgtttctggggcagatattcaagcgaaacaagcgagtatcatcggtggtcaaacccattttggtacacaaatcacaacgaacgaaagtaacgcacgtaaacatcaatctaaaggtctttggttccgtgaagaaaccgataaaactaaagctcaaactgttcaccgtaccactgtgactgcagataaactcaatgtggtagcaacaaaaggtcaagtaacggggaatgcggttaaattagcagggcaagatgcttttgtttatggtgataaaggcgttgcattaaaaggtgttacacaaacaacacaagctgaagcgacaagcaaatttaaaaatgaaactgcccgcttgcgtacaggttctagttcacaaacagccaatacccaagcgttagtggcaagtgaattacaatttaaaaaccttagcgtaggtggcagcgatgtacatttgagtgcggtgaaaggtcaaattgacggtcaactctttgtgcaaaataaaggtaaagctgaatttgtcagccaagcgaccaaaaacacttacaactgatttcaacaaaaggcattaacgttattggtagtaaagtgcaagcggtgaatactttaggggtttatgcaccaaccgttgaagtgattggggcgaaaaaccaaagtttatcaatgaaagaagaagctggatttggtatttccgcaaaaggcgataagccaaaagtgacctttaataccgaagcggcactacgtggtgttatcacatcactgttcaaaggcgaatcagtaaacgcacttaatgttgttaaaggcaatactcaatttgaagcacaaggcagcattaccttaggcatttataaccacaaacaacagaatagccaaacacaaactgcacaagcgagccaattaagtgcgaaacaaaacctcactttagaggcagagcgtattcaacatcaaggttcacaactttctgcaggcaataacattgcacaaggtgcagaacatatcgaacattctgtggcaacgaactcacaaaatgatcgcaccaaaaatgtggacgtaggattgtcggtcacttcatcgatcaacaaagataaagcgatcagcagttctgtcaccttatctgcttcaggtggtcgtgaaaacagccaaagcaccacagcacaagcaacgactctcaatgccggcaatagcattgtgatcaacggtcaaaccttgcaagatactgcaacacaatatcaagctggtggcgatttaacccttaactctcaacaacataacttacaagcagccgtaaatagcagcagtaaagatacaatgaaggcaggggtaaatatcggcgttagtggcaacacgagcgacctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcaacacgagcgacctcaaaaccgttaatctgaaagtgaatgtaggtgcaaattaccaacaaaatcagaccgcttctgagcaagctcaaaaagcctctttaactgcgaataacattgcggtaaatacaaacacgctttacagccaagcggatatgaaagcagatggcaacattaacgtggtggcgaaagagagtgcaacctttgctcaagcaacgaataaagagcaacaaaatggcgtaggctttaaagcagatcttggcgtaggggcattagtcgttcctgccgcaagtgctgctattccaagcgttgatgcaagtgtttcagtaaatgccgtaaatggtcgcacacaagatgcggttaccgctaaagttgaagggcaatcaatcaccattcaaagcggtaaaaatacgctagtacaaggcacaagtttggcggcggacaacatcaacttaagcggtgagaccgtcaatgttgtggcagcgaaaagcgataaacaactcactgatgttgcagtgggtacggcaatatccttaggtaaaggtgcatcaagtttaggcttaaatgcgaacttgaaagtacatcatgaagtttctaatagccatactgcaagtcaagttaccgctcaaaatctgaatattcaaagcagaaatgacattacccttactggcgtacaagcagatgcgaaaaatgtgaccctaaacagtggcaatggcaaccttgctttaaccgctttacaggataatgtgaagaaaacaggcgtaggtgcaacactctcattaaatggtggtgtagcagaacaaaaatggacaccaaatggcggcagtgcttcccttgatgtgaatgttattcgcaatcaaacccacacaagtaccgtagttaatagtgaaactgcgaacctcaatgtaggtggtaatgcactcttaacaggtagtgcattaaatgcggacactgtttctggtactgtgacaggcgacttaatcagcaaaggacttgtgaataaagtcagcgaaacaagtgtgagcgtttctgcaagttaaaccaatccaacataaccatcattaaataagtaagataaattagggaaaaaattgaattaaacggaataatgtgaaataaaaaatgaaaaggcattacacatagagaaataaaaaactcagccgagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaatatctttttctgcctgctcaatggtaactgtcgttttctcgttgttagcgctgtctttcttctcaaaagacacttccaacttagtattatcaccatgaggacgagcgaccatatcaccattactgagctgttcaagagaaggtttatctgcaacaacgtcttgatcttgacggagatcgctgcctacggtaattgatgtattagaggtgagtcgatctggttgaccatttgccccttgtgttttttcaaccgcatctttaccttctgctggcaatcctaacgcattgtagcctttggcagtcacaggggagtcatccttaaccgcatttgcgttaagggtaatcttgcctgtgttcggatcaatagttgcaataccagcatctttagcagaaacaagtccaacaccctgtggattgctagggttttcgccgttgtctgccggtgctgtttgtgcttgttgtaacttctcataatctgctttggttgcagcaaagagttcccaaacaccattaactttctgagccactaacaccatatctatatcttcattgactgatgcaccatcctgagatttcactgttgggataggctgattattggtgttggttgaatatcccggcatcgctgtcggagtcatggtgtagcctttgaaggacacaacaactttctcattatccccttgcggttcaatgattgcagtaccttgttgataggtattatccttacctttcaccaaatgaggcgcatcagcttctttcggtgtagtatcatctaccaacgccttaatcttggcttcctgtacggttgtcaatctagtgccgttttctgttgtatcactagtttcataaggtttgtttgatgctactgattcatttccaacagtcttataaccaatcgcttctgcttccgaaccatccttcactttcggacctttaacaattacagtaccgtcttctttgatgatatagtcgtccttagcaggttttttatctgcatcagtcggatgtgtttcatccaacacccacttaccttgctcaagatctttcttcacagcaatttctttatcctgaccgctattatccttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgcagaatgcattgttttataagggatattggtagagatgtggtgttttatttattgtattttcttttgctataatacggtttcccatgtttttttgaagtggtttaattcatgttaaattttgaaaatttaccttctcttcttacaggaaagagcagacagcatttggttgccttaccaaataaattatctgatcagcatgcattacaatctgaagtagtaaaagcatttttgcatttacaagatgccgcactgaaagcaggttttaatttacaacctgcaagtacttatcgggattttgaacgacaaaaatggatttggaatacaaaattcaatggtgaaaataaagttcatgatgatcatggtaaagctatcatattaactggcttagatgattgggacaaatgtcaagctatcctgcgttggtccgcagtgccaggggctagccgtcaccattggggaacagaaattgatatttttgatcctactttacttcctgaaggaaaaaagctcatgttggaaccgtgggaatatcagacaggaggctattttcaacatttaacgaattggttattagtcaatgccgaacgttttggtttttatttcccttttatggaagctaataataagtttattggtctagaaccatggcatatgagctatttccctatttcggaacaatatgagcgattactgtccccagagatgttgcaaatggcttggcaaggcgagaatatcgctggtgtaaatagtttgaatgagcatatttctgagttatttgaatattacattttgtaaatgtccctttctgcttttttattacttaaagataattttcaagatcaatcaccttatcacaactccgttcaatcaaaaacggatcgtggctgacgataattaatccgcagtttctcgctcggcattgttcaatcagcaatttgatcgtttcttgttgggtgatcggatctaaacgagaagtcacttcatcggcaaacagtagcacgggttcaagcagtaaagctcgcaaaattgcaacccgttgcaactcgccacccgatacgttatcggcgttgcgttgcagaatgtcaggcgacagtgtgagctgtgttaataacgctggaatttgtgaacggtcgagatgatgatgttcgatcacatcgtccaataattgttgcaagctcacatttggtgcaaaggcttcgggcggatcttgatacaatttcagcacttgatgttttttatggctgtggctatgccaaatcacttcgccagattgcggtttaagtagtccgcaaagtacgtcggcaagggtgcttttgcctatgccactgtatccgacaatgcctaaaatttcgccttggtgtaaatcgaaggaaagctgtttgaacagcgttcttgttccccgtgcgaccgttaaatttttgacagaaacaagcggtgtttttgacgtagaatgttgcaaatcagccaaaggttgccaatgttgcggatctgcaccgattaaggcttgagtataaggatcttgcggttggctcagcagttgttccgcttcgccttgttcgatcaatttgccttttttcattacgaaaatatagccaccgagagcggtcgccacttcaatatcgtgagtgatcgtcagcaagctaccgcctgtttcataggcttgtttcagcaagttaatcacttccgctttgctattcggatcaagtcctttggtgggctcatcggcaagcagaattttcccccctgatgcggtcgctatcgcaaaggaagctctctgtgccataccacctgaaagttggtgtggatagcgttgttgagcctgagataaacccagctgggttaaagaaatctcgctcgccttttctgcatttttctggcttaaacctgccacaaagcgaaagctctcccacagttgtcggctaattcgcatcagtggatttaatgaacggcgtggctcttggggcaacatcactaaggttttgccccaaagagattgtaagcggtcggattgcccgtctattttgcaattttccaccacaatctcaccgcttgcggttaagccttgcggtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaacgcccccataattgcttgaattaacaggctttttcctgaaccagtttcgcctaaaatggagatgtttttgccacgttcaagacaaaagctgatcggctcgaccagttcaatgccatcaagtgtttgaacagtgacgttggttattttgagtaatgacacggtgttttctctactatatttcaatggattttacattaaccttcgtactatgctacgtttgattcttcccccacttgtgggggaaggtgcccgaagggaggatgggggctatttacatttagctttattccccttttcccccatccccctcgctgtcgcttggggacttcccccataaatgggggaagtattttgatagagaaggaaatatgcacgatagttaatgttcaaatttacttcaccttaggaacacagcaattacaggttgtaggaaaatcaatggggcttgatagtgataggggaacagctctgtcatcatcagccctaattcagccgtaggcggtcgcaatcctacgttgacaaaccccagtgttgcaagggctaaaatcgcattaccgattgaaaatgcggttaatgtggcaaccatcggcagtaaacgggggaacagatgacgtttaatgcaataaaaccaaggcattcccatcaaacgagaagattgcagttctgagctggacgcaagggtactggtgatcgccctgatgacacggaaaaattcaacccaaatcactaaggcaatacctaaatagagtgtccaaaatgaaccaggggaaagcgaagcaaacagcaaaatcagcaataaacctggtaatgccatcactaaatcacagataaagctaaacaagcgatctaaccaaccgccaaataatcctgccagaatgccgaataacaagcctgccaccaatgcacaagcaacactaaatagcgataaaccgaatgaaaggcgaatggcggaggcaagacgggcaaacatatctcgccctaaatgatcggtgccaaaccagctttctgcatcaggacttgccaacatattgctgagatcttgaaaaccaatatccatcgggtagaaataaggctgtaaaaatgcagtggtgagtagcagtagtaataacaaagctccgcaacgttgtccaacggttaatttcatactgttcccccttcacgaatacgcggatcaatccacgcattaagcagatcggcaagcatattgagtaccacaaataatccccccatcactaacgccgtgccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttgtatcatcggcacatctcgtgcaatgatggcgtgaactaaagcgtgtccgcttcccggccaagcaaaaaggctttcgacaatcaccaccccttcaatcaggtaaaccagttgcacgctatgataagcaatcactggcacggcaatattcgggatcccatgtcgcacaaaggtctgccaacggctcaagccttttagctgtgcaaattgatagtagtcggattgcatcacctgcaccattgcttgacgtgtcacacgcaccgaaacggcacttaaacctatcgctaaggtgagtgctggcaagacaaaatgcaatgccgtgccgtatccgcctgctggtaaccatttcaactgaacggaaaaaagcgtaatcaacccaatcgcaatgataaaagcaggcacggcacgaaataaactgcttaagactaaggtcaagcggtcaaatacgccgttcggtttacgagctgataatacgcctaagatgggcccaatgagcaaggctaacagtaacgctaccaccgctagactaaaggtatgcccgaattgatgttcaatttcgtgccaaacgctgtcgcctgtgactaaggatttacctaagttaaactgcactaaatccgctaaccaactgccgtaagtttgccaccaaggttgatccaacccgagttctgctcgcaccatttctgcggcggcggcatcggtttgatcgtaaccgtagcgacttgccgcaatacgatatgccatatcgcccgacaattgccgagttaaaataaaagtcaaagtcccgaccgaccaaatcaccaaaaggatctgggatagtcgtctgaataaaatagaaagcacggggataaatccttaaaatctgctgtagggacacactgcgtgtgtccgctaattgtggctttttaagcggacacacgcagtgtgtccctacattttatttactcaacatctccaaaaagaaccgtctttcaaaaggatctaaagtcacatttttcacgtctttatgtgccaccacattttgctgatagtacaccacgggaataatcggcagttcatcgtggataatttggctcacagtctgttttaacgccttcgctttttgcagatcacgttctgtttcaagctgagttaaagcgttgtctaatgtcgcattttgccaattcatcaccccccaatcgcttcctgttttcgcataatcctgcacgatcacaccaaaaggatctaaggttttgccatagttcaaagcataaagtgccatctctaaactgccgtcttggtgtccagcagggatttcactgaagttaccgacagacacattcacatcaacgccaatctgcttccattgagcttgcaaaattgtcgcaatcattggtaattcagggcgatcggagaatgtgcgtagggtaaaactaaacggcttaccgtctttagttagcttgccttcgctattaaattcataaccacgagcggttagatctgctttgatttttgcaagatcaggttttgctgttgtcgtatcaattcgccattccgcaaaggctttcggcagaatttgatccgcttcgccaccttcgatttttaacacatattccgcaattgctttgcgatcaatcgcttcacttaaggctttacgcaccgctaaatcattgaagaatggttttgccacgtccattttgagctgaatagtacgagcaatagacacactggttaagttcaaattcggatcggttttcaaacgctcaacactggcggtatcaaggttaaacactaaggcagatttatcgctttgtgccatcagcattcgggtttcactacggctacttgcaaggtagttcgcttgagccagtttcggtttattaccccaatactgttcaaaacgcaccgattccaatttttgtggtgcttcaattttagtcgctttaaatgcccccgtgccgatcactttggtcacttcccctttgtcgttatagctttcaggggcaagaataattgcggtgtagtgtgttaaaaaagatggaaacggcacaaaagatttggttaaggcaatttgaatttctgtcgggctgaccgcttgaatatctttaataaaggctttttgcaacattcccggtttcgccaatgcaatatttagactgtttgccaccgcttgtgcagttaaaggttgcccattgtggaaaatcacattcggacggagtttaaaggtccaaagggtcgcatcttcattgctgttccactcggtagccaatcctgcaacaagttccccctgtaaattcgcttctactaaggtttccgctaaattcatacgttgaaaaatcacccctgtctggttcggatcaaggctattgatttcccaaggggcaaccaccgttgccagagcaagttcatcattttgctttgtttgagttgtcggttcagtcggctttgccgtttctgttgctgtggctttatcaccttgaaaatagtgaaccgccaacgctgcaacaccaccgactaaaaatagagcaagaaattttttcattgttatatcccttaaaataataatggttttcaaaaaggcgtgtattgtgccataaattccataaaaaaatagtgggatgttaaaaaatttatcaccgaagagtgtgcccgtagagggattagatagtaactaagactatctgttcaggatcgatatgtatccatacctgttgattttcttggagcggttgagcttttttgaccgttgcgtaacattccgttccatttgcgtttaatgcaatttctttatattcccctttgtcgtaaattgcttcgactttggctgctaggctgtttgggcgttgtgggtgttcggggtgaatttcaatccacggcgctttgaccattaacattacctctttcccttgtgttagtttgagccgttttgcgctttgggtagtaatggaagcggtgagttcctgtggaaattctgcaatgtgaatatcaacgtagcaatgaacatcttcttctctcaattgggtgacagtgccaaaaaattggtttctggcactgctttgtagggagaatttggctgttgcagtgagtaagctatctagggggatgctttcatcttgaaggatcgcaaaggcttttgcttgggtctgttcaagtaaatcgtagagctgaagtaaccgctcggcatagggggttaggtcagtaccgccgccgtgtttgcctcctgtgttgcgttcaagaagtggtttagggctgatgttgttcatcgcctcaagatgatcccaagcacttttgtagctgacgttggcgttttttgccgcttggtttattgagccacattcttgaatagctttgagtagggtaatccgtttgggatcgacaaaaagctgttgttttagtttgatggttaataggatttcgttgtttaacataggctgcctttttgcaaaatagaacgctgaaattatctactttcttgtattaaaaggaaatgtaatttttacctttgtatttattttataattcgttatataatagtttatatattgttatatccactctcataaggattatttatgaaaaaaacgtttgtaaaattagctttagcgtcagcattggctttgggggctacttctgcgtttgctcaaaatattacggtatttgcggcagcgtctatgacaaatgtgttgcaacagattggtgatgagtataaaaaaacttatccagaggatagtttgaccttttcttttgcggggtcttcaactttagcaaaacagattgagcaagatgctcctgcagatttgtttgtgtctgcggatcaaaaatggatggattatgtggctgagaagctgcctgccaaaacaaaaaatgtgacaacgttggttgaaaatgagttggtgctgatttcgcctgcagacagtaaaattaaagtggcatctattaaggatattaactttaaaaaggtgatcggagatagctatttggcggtgggcgatgataatgtgcctgttggtcgctatgcgaagaaagcgttagaacatttaggcgtttgggctgaggttgagcctcgtttgtctaaggcaaaagatgtgcgagcggtgctttcttatattgagcgtggtgagttgccgttggggattgtgtattcaaccgatgcgaaagtgagtgataaggtgaaagttgtcgcggttttccctcaagagagttatggcaaggtggtttatcctgcggcaaccttaagcgataagcctgaagcaaaacgtttcttagactttttagcgacaccaaaagcgaaagaggcttttgcgaaagctgggtttaaggcagttagatagccttcggatttgacctgctattagtgagatgagtttatattccctcctactatagcgtttatctttgatattccacccatcctttttctttatcttcccccgcttaggggaaaataaagaaatcgtcagacataattatatcgagtgaaaatagattcactatttccttttctgggcttcattttccatttgttctacacataagtgaagaatttgatccgcaccttcttggatatatttatcgtgacgcactttattggcttgaatatctaacattgcatcatagataccctgtgtaatgcttggtgtttgaaccattgtccagcaggttgggcttagacgattaaaattattttgtagatcggcagcataaagtacgccgctataataagcatacacgttatgatctaacattcgatttaacaggcttgcccgaatttgttctatcgggtgcttgactttcttgttaaaccaatcatcaaccccacggataaaagatgtaatatcataactttcattcacgcgatctgcataagtttgctctactgcaccataagcaatcgcataggatttttgatcgatttgggattcgggtaaacgcttccaaccgcttgtattagtgctacaagctgttaccaatatcaatgtaaaaatgacagcaactcgtttgtataaagatttcatcatttactccttatctctctgtactaaaaaagtgttacaattctaacaaattattttacggattactctaaacattttaaggttgaattatgaaacaatatcttgatctctgccaacgtattgtcgaacaagggaagtgggttgaaaatgaacgtacgggtaagcgttgtttaaccgtgattaacgccgatttaacctatgatgtggcaaagggtgcatttccccttgtgactacacgcaaaagtttctggaaagcggcaattgcggaattactcggttatatccgtggttatgataatgctgcagatttccgtcagcttggcacaaaatcgtgggacgcaaatgccaatgaaaatgcagcttggctggcaaacccacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaacccacatcgcaaaggcgaagatgatatggggctggtttatggtgcggtcgggcgaaacttcccgaaagttggcggtggtagcgtcgatttattacgtcaaattgtcgatgatctgaagcgtggtgtcgataatcgtggtgagatttatacgttctatcacccaggggctttccatatgggctgcctacgcccgtgtttacacagtcatcatttttcattgctggatggcacgctttatttgaacagtacccaacgatctgccgatgttccgctcggtttaaactggaatatgatccaatgttacacttttcttgcgttaatggcacaaattacaggactccaagcaggacaagcgttccataaaattgtgaatgctcatatttatgaagatcagctggaattaatgcgagatgtgcaactgaaacgcacgccatttaaagctccaacactcaaaatcaaccccgatattaaatccctagaagatttagaaacttgggtaaccttggcggattttgaagtcgagagctacgaatatcatccgagtattcagtatccgttttctgtgtagttggaaaaatttttgctatcttcagactttattatttctctttatataaatgattggaaggtaggatatttgaaaaagtgtgcaataatttcctaaaaaatcatcgaacaatagaaaatcgctgatttgtgtttgacaagcatataaaaatctctaaaatacgccgcaacgaatatgttgtgttaagcaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgataaaaactgcatctatcacccatcttcttttctagatctagataaaaagttttttctattccattatttactctttttcctttctatttagaaaatctttgcaatatctttaagataatattaaattcaacttgattatagtttggcgtgatttctataaatgcgatattagctttgcgacaagcctccctttttattgcatctctttccgctgcattatgttgataatgagcgtgcccttgatattcgatgactgcaataggattgctttgtttatctgtgataagaaaatcaacccttttgtgattaatttttgcataggcttcatcctgttccgctttgataaactcccccatggcgacttgagaaaatagaagaaaatgtgaatcaaggttgtgtgattttaggtaatttaataaaagatagaataaacgatgttcacttttgttcattaatgggactttatggtaactcgacttagcaactattgctaagttggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatgtgtaaagccttttgggaatatcggagtatcaatagtagctctcctagataatgtcgttcttttccggctattagatatggttattccaaaagcaaagatgagtatggcactagcaataatgagtaatagctgactgtgttcaaataaataggtaagagacattgcgtactccatttgtaaatataaagttgtcataaagtaaaaaaattttgtgattgctgcaattggattcttttaatttttcgacagagatcgaaaaatttattttttctcatagcaaacgtttgcgtaagtcgatataattattctattctttgtttagatattggaactttgttatgcaaatcagcctaaaaaaaatctattctggtaaagttcgtgatctctacgaaattgatgataaacgcatgttaatggtcgcaaccgaccgcttgtctgcttttgatgtcatcttagatgatccaatccctcgtaaaggggaaatcctgacgcaaatttctaatttttggttcaataaattagcccatattatgccgaaccattttacgggagattctgtttttgacgtgctaccacgagcagaagcagaagctattcaacatcgtgccgttgtttgtaagcggttagtcccagtaaaaattgaatctattgtgcgtggctatttgacgggtagtggtttaaaagattatcaaaaaacagggactatttgtggtttgacattgcccgaaggtttggttgaagcaagcaagttacctgagccaatttttaccccttcaagtaaagcggaagttggcgaccacgatattaatatcagctacgctgaatgtgagcgtcagattggggtagagctagcggcaaaagtacgagatgcagccatagcactttataaaaaagcggcagattatgctttaactaaagggatcattatttgtgatactaaatttgaatttggtttagatgaaaatggcgtattaacattgatggacgaagttttgacccctgactctagccgtttttggtcagttgaaacctatcaagaaggaagtaatcccccgtcttttgataaacagtttattcgtgattggttagagcagagtggttggaacaaacaggctccagcccctagtgtgcctgctgatgtgattgaaaaaactgtggcgaagtatcaagaggctttggaactcttgactcaataggctgtgtaagcggtgaaatcattgcaaaaatttcaatattatgtagcaattgcataaacatttaattttttgtaggggcggggaaaaccttacccctacataaattttcttaatatagatcatcgtaaatttacttgatcttttctttttaaagcgtatcatacgtcctcttttttcacttgggttccctcaccccaaacaaccaaacttatataaaaaggaacaatatgaacgtatttgattacttttctgacgagcagaagcgtcgctcgttgctattactttctctttttcacatatttatcatcacaatcagtaactatttagtacagattgcgtttgaaattccaatcccttttactcaaacgacgatcccaacaacttgggggacttttacctttccgtttatctttttagcaacggatttaacggttcgtgtatttggtgcgtcacttgctagaaaaattattttagcggtaatgttgccagcattgatcgttagctatgtgatctcggtgattttctttgaggggcaatttcagggagtagctacattggcggagttcaatctatttgttttccgtattgcattagcaagttttgcaggttatgtggtgggtcaattaatggatatttttgtctttaaccgcttgcgtcaaggcaaaacgtggtggcttgcccctgcaagctcaacgattttcggtagtttaattgatacatttgtgttctttgcagtggcattttataaaagtagtgatgaatatatggcggaacactggtttactattggagcagttgattatgcattcaaattgtttgtcagtctgttgctctttttaccgctctatggcctagtacttaattttttaattaaaaaattaaatttaaaacgctttaattaagtaggcttcttcccatccttttggatgggaagaaaatacctccttacttgtttggcgcttgccccaatattctcgtcaataattcccaataaatttcaacagcaggaatatgcactttttcatctggagaatgggcattacggattgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacggattgttgggccaatagaaaccacatcaatgtttggatagactttcttaatcaagccacactctaggcctgcgtgaatcactttaatttgagattcatagcccagtatttcatcataaatcgctttggtaagtggcgtaatggcggatgttgggtctggttcccaacctggataaccaccagagaaagtggctattgcaccgaccagttctgccaatgaagttaaacgagaacgtacgtctgctttgccgttttcaattaatgaacgcactaaaatattcgcttttaccccttgttcatcgctagtcaaaatgccaatgctcaatgaagtttctaccacattttcgaccacatcgctattgcgaattacgccgtttggtagcacgttgaggaactgaatgactttctcactgctctctttggcaaaaatctgtgacggcttggcaaccttttccacaataaaatgtaaattaggttcagcaaaagctaactcacgttgcaatgcttgttcaaactgacgcaaataagcggtcagattgtcttgatcttttgcattaaagccaatggaaacgaccgcttctctaggaattgcattacgcacggagccaccacgaattgcaccgatttgaaaatcaaaatgcgattttaactcagccaacgtacgagctattagtttaatggcattagctcttgttgtatgaatgtcacagcctgaatgtccgccatttaagccttttagacttatctgtaaggttgtatcaaaaggattttgttcatagttcacaggcaagattaaggtcgcatcttcgccacctgcacaaccaatgtaaatttcaccgttatcttcggtatccgtattaatcaaaatatccgctttcagccaatttggacgtaagcctaaaaccccttccataccagcctcttctgtcattgtgagcaaggcttcgatttcagggtgaacaagatcatcagcgtctaacaccgccaaacaagaggctaaaccgatcccgttatccgccccaagtgtcgtgccttttgccttgacccattcgccgtcaatataaggttgaataggatcttttttgaaatcgtgcaatgttccttcatttgcttgtggcaccatatctaaatgggcttgcaatgccaccgttttacgatcttccattccttttgttgcaggtttgcgaattaaaacattgccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacattgccagcttcatcacgttctacaaaaagctgtttctgctttgcccagttcacaacaaattgagcgatttcttcttcgtgataagaggggtgtggaatggcacagatttgatcaaaccatttccataataagtgaggtttaagtgtttgaatttctgacatatcgatttcctataaacaataatagcggtgagtttcctgtaaaattttgcaaaattcattcggataaataagtttattgtaaaatttgccttgaaatgatagcacgaaagttgttttcaggttatcatttcgcaatttttttattcggtggcatcgccaccgctttttttaggtgaacttatgagtgagaaatacacaaatgaaaaatatgtcgtgacgtgggatatgtttcatatgcacgcacgcaaattagctgaacgtcttttacctgcatcacaatggaaaggcattattgccgtcagtcgtggtggtttattccctgctgcagtattggctcgtgaattaagtattcgccacgtcgaaacggtgtgtatcgcaagttatgaccacgatcatcaaggtgaattaaaagtgttacacgctgcacaagtggcaaatggtggtgaaggttttatcgttgttgatgatttagtggatacagggaatactgctcgtgctattcgtgaaatgtacccgaatgcaaaatttgtcaccgtgtttgctaaaccaatgggggcagagttagtagatgattatgtggttgatattccacaagaaacgtggattgagcaaccttgggatttaggtattacctttgttccaccccttgcgaaaaaataaaattcagtgttagggacgcttttgcgtccttaattttttacgctattatttacataaataatcgtagggacacactgcgtgtgtcccaggctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccactctatttttagaatttgacagtagcggacacacgcagtgtgtccctactgatatataaaggacaacaatcaatgcactttgaaagacgtagccactggagtggtgaactaggacgtgaaatgcatttcaacgtctatggacacgcaggcaaaccagttatcgtattcccatcatcaggtggcaaccaaaacgaatacggcaattttggtatgatcgaagcctgccgttcttttatcgatcgtggcttaagtaaattctataccccagactcttttgacagcgaatcttggcttgcagaatggaaatcgggacacgatatggcacaggctcataacgcttacgaccgttatatcatcaatgaatttgttccgttaattcgccacgaatctcagtgggagggagcaatgatcgcaacaggttgcagtatgggggcttaccatacgatcaactttgcattacgccacccagatctgtttgatactgcaattgctttaagtggtgtttacgatgctcgtttctttacaaaagagttttacggcgatcttgcaattcacattaattcaccgattgattacctttggaatcaacacgatagctggttcttagatcgttatcgtcaaaatcattatatcgttgccgtaggacaaggtgcgtgggaagctcaacacgttgaagacactcgtcgtctgcaagatgcctttgctagcaaaggtattcaaggctggttcgactactggggacacgatatggcacacgactggcctttatggcgtatgcaaatgccttatttccttgggaagttggaagagcagggaattatttacacctgattctctacgggctgtaaatccaacaaggatattttaaatggattattttcactataaaaaccaacaacttttcgcagaagatgtcgccattacagacattattgcgcagcatggcacaccagcttatatttactctcgggcaacacttgaacgccattggcatgcttttgataaggcatttggtgatcacccacacttaatttgcttcgcagtcaaatctaactctaaccttgccctgctaaatgtaatggctcgtttaggctcaggctttgacattgtttctcaaggggaattagagcgagtattagctgcagggggggatgcaagtaaagtggttttctctggggtggcaaaatcgcatagagaaattgctcgtgctttagaagttggcattcgttgttttaatgttgagtcggtttctgaattaaaacgcattaacgaagttgcaggacaacttggtaagattgccccaatttcattacgtgtaaatccagatgtcgatgctaaaactcacccttatatttcgacagggttaaaagaaaataaatttggtgtaagtgtcaaagaggctcgtgaagtttatcgttttgctactaccttacctcatgtaaaaattacaggaatggattgccatattggttcacaacttaccgaattacagccatttttagatgccactgaccgtgtgattgtgcttatggaacagctaaaacaggatggtatcgaactgcatcaccttgatcttggcggtggcttaggggtgacttatacggatgaaacaccgccacacccaatggaatatgctgcagcgttgctccataaacttcgaacctacccaaaccttgagatcattttagagccagggagagcgattactgcaaatgcaggtattttagtcactaaagttgaatatattaaacaaaatgaagatcgacgctttgccattgtagatacagggatgaacgatatgatccgccctgcattatatgaagcgtatatgcaaattattgaagtaaaccaatcgcttgtacgtgaaaaggcaatttacgatgtcgttggaccaatttgtgaaacgtcagactttttaggtaaacagcgagaacttgcaattaccgaaggagatctgattgcaatgcgttctgccggagcttatggtgcaacaatgtcctcaacttacaattcacgtccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaacttacaattcacgtccacaagctatagaagtgatggttgatggtgataaagctcacttaattaaagctagagcaagttttgaagatttatggcgtttagagaatatagtgcctctttgtaattaatttcattcggagtatttaatgcaaaagcaaccatctatttttggcggtgcctgtatcattgcaagtgtatgtgttggcggcggaatgttaggactaccgagtgctggagcaggagcatggacagtatggactgcagttgtaatgttaattacaatgatagttatgacgatttctggtgcaatgctacttgaagcatataaaaattatgaccttcgagcctcttttaacacagttactaaagatatactgggaaataaagtaaatataattagcaacatttctatctactttgtgggaggtattttgctatatgcatatataacctctcttggatatctatttcaagatttgcttaatatcacaaatcaactatctgctattatttgcgttttagtcttcggcggattagtttggcactcaactcgagctgttgatagaatttccatcattctaattatttttatggtattgagcttcatctttagcatctggggacttgctactaatattaatttttcctatctttttgatactgtcaataaagagcaaaatgcttatgcacagtataccatgatgatgttacctatagctctgacttcttttggctaccatcattcagtctcctcaatgagggcatactacggtgaagaaaaaagagcatctaaagccataatttatggaaccatgattgctctggttttctatctaatatggattggttgcgtatttggcaaccttccaagagaaaaatttacccctgttattcaaaatgaaggaaacattgatgtactattaaatacattaggcaatgtaataaatacaccaagtataaagcaagcactcaatgcattttctatcgcagctattttatcttctttcattggggttggacttggagtttttgactttttagcagatctcttccaattcaaaaacgataaattaggtagaacaaaaagttggtttgccacatttataccgcctctcctattatctttactctttccatttggatttatcactgcaataggatatgctggagccgtggcaactatttggacatgtattattcctgcgttactaatatataaacaacgccaaaaaacaagactatatggatttaaagcttttggtggaacaccaatgatttggtttattgccttatttggagtcttcgttgcgattttccacatcttaacaatgctaaagatgttacctatattcataggatagattatagatatggtctatagctaatttaacattcaaaataacataatgaaaaatcaaaataatttcctacagcacacgccaatgatggctcaatatctccaactcaaagcacaaaatcccgatattcttctgttctatcgtatgggcgatttttatgagttattttacgacgatgccaaaaaagcggctgcgttgttagatatttctctgactaaacgtgggcaatcagcaggtgaaccaattccaatggctggggtaccgtatcacgctgttgaaggttatttggcgaagttggtggcgttgggtgagagtgtggcgatttgtgagcaaatcggcgatcctgcaaccagtaaaggccctgttgagcgtaaagtcgtacgaattatcacacctggaacggtcagcgacgaagcgttgctaccagaacgccaagacaatttggtcgccgcaatttatcaagaaaaaggcgttttcgcccttgcgacattagatatggcttctgggcgttttttgattagcgaattacctaacaaagaggcactgtctgctgagttacaacgcacccaacctgccgagattttgtatcctgaagatttttctgatgtaggtattttacagggttacaaaggcttacgccgccgacctgtttgggaatttgagctagttacagccattcagttgcttaatcgccaatttgggacacaaaatcttacaggttttggagtagaaaaggcggtggttgccttgtgtgcggctggttgtgtcttgcattatgctcaagaaactcaacgcaccgcactgccacatatcaacagcattcatttggctcaaaatagcgatactgtcttacttgattcggcaactcgcagaaatttggaattaaccaccaatctggcaggcggtacagaaaacacacttacatcggttttggataaatgcgtcacctcaatggggagtcgtttactcaaacgttggatccatcaacctattcgtgatttagccaaactgcatactcgccagcaaactattttggcattgcaaaaaaatgaacgtatcgaaccgcttcagcccctgctacaacaagtaggcgatatggaacggattttggctcgcgttgcattacgcactgctcgccctcgtgacctaacccgtttacgcacagctttagagcatattcccgatattgtaaaacattcacaacatcagaccgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaatactttgcagcagatcgccgattttagcgagctattcgagctattaaaccaagcaatcattgataacccaccgcaacttatccgtgacggtggcgttatcgccgaaggctacaatgctgagttggacgaatggcgaagtttggcagaaggggcaaccaaattccttgaagatttagaagcgagagaacgagccaaaacaggcattgatacccttaaaatcggattcaatgcggtacacggctactatatccaaatcagtcaaggacaggctcacaaagctccgatccactatgtccgccgtcaaaccttaaagaatgcggaacgttacattatccctgagctgaaaacctatgaagataaggtgttgaaagccaaaggggcttctcttgcccttgaaaaacagctttatgatgaactgtttgaactgttaatgccacgtttgggtgaattgcagttggcaagctttgtgttagcagaacttgatgtgctgaccaaccttgccgaacgtgccgaaagtttgaattatgtaatgccaagtttcagccatcagcgaggcgtgaatatcaaaggcggtcgccaccctgttgttgaacaagtactgaaaacaccgtttatcgccaaccctgtactgctcaatccacaacgccatttgctgatcgtcacaggtccgaatatgggcggtaaaagtacctatatgcgacaaattgccttgattactttaatggcatatatcggcagttttgtgcctgcggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgcagaaatcggaccgattgaccgtatttttacccgtatcggtgcttctgatgatttagcttcagggcgttcaacctttatggtggaaatgaccgaaatggcgaacattctgcaccaatccagcgaaaacagccttgttcttgttgatgaaatcgggcgaggcacctcgacctacgatggcttatcactcgcttgggcgtgtgccgaatggttagcgaagaaaacccaatcgctcaccctatttgccacccactactttgagctaaccagcttaccaaaccagctcaaaggcgttgccaatatccatttagatgcgttggaacataacgacactatcgcctttatgcacagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatcgcctttatgcacagcgtacaagaaggggcagcaagtaaaagttatggtttagccgttgccgccctagcaggcgtaccaaagcaggtgatccaacttgcgaaacagaaactcacacagcttgaacgactttcgcaacaaacggcacaattagacgcaaatcaacagcaagatttactcttttcggcgaatttgcaaaatgctgaaccaatctcaccgcttatcgaaccgtccaaagtcgaacaagccctcgcagagattgatcccgatgaactcacaccgaaacaggcgttggagatgttgtatcggttgaagttacttataaaataaagacatcttggaatgtagacaaaattggagattataataaaaagccccatttctaactgctcaggaactataaaacggcactaagcctttttatcattgaatttactgagtttttgaatgatcacatttaaattagtatggggctttacctagaatgtgagataggtgttagataaaatgtaagtcatcttttcctcttttcacgacccttgtataatagctgagcttttttaagcaatgacaatttattttatttcagatatcacaagggccttattatgaaaaacatcttaacttggcctgtggttgcaggtgctgcacttggtatcgttgggctgcttgcgggtgtttttgcagggattttcttcttcaaacgtggattttcgctcggtaagtccggcgaacaaagtacagcatccagcatagtccctatttttattgtgatcgccctgtttattgccctgatcacccaattccgctttggtgaaaacttacccattttcttctctgaaaagcccctgccgcccaacatgccaacctatggctttcattaggtgctggtgtgcttgtcggtatcgttatgcaacgctctcgtttttgttcaatcggtgcattccgtaattttatcttatccaaagacagctatctgctaaacggaattgttgcattggtggtatgtacgtctataaccaacctaatgctgggtcagttcaaacttggttttgaacaacaaccaattgcccataatgatgttgtatggaacttcctgagtatgacactgtgcggcttatgtttttctctcgcaggaggctgcccaggtaaacaactggtgcatttaggtgaaggtaataatgatgcggcacttttccttgtcggaatgctattaggtgcggctgcagctcataatttttcgctggcagcatcaggtacaggcatatccacctttacaccttatggggttggacttgggctgcttttctgtctctatattggatttaccaataagtctactcattagaactagggtactgtgccttattaatgaaatactgacgtacttcaggtacagtacccgattatacttaggttatattttctaacccaataattgtgagataagtctaaagactctatactgaatcagtatagaatctttagctagcggtcatcacaaatgatagtatcgcaaaactttttaattaatgattacatagaaatttgaaccattacgcaaaatatttaaggcaatggcagatggattagaatcaagaaccttacgcaactcgcctaaattctcaacggtacgacgatttacaccaacaatcacatcgccttttctaaatcctcttgcctcagcgagtgaatttttttcaactttagtgatttcaacgccttttattcctttttcgttatagtttgaaaactcagcaccatttaaacttggtaataaacttttcgcacttgttttggtttgttcgtcagattgtaatgtgactttaacatttttctctttaccatcacgtaaataggttaattcaatttctttgccagctccagtagtcgctacttttgctcttagttctgcgaaactacggattttttgaccatttagccctgtaatcacatcacctgctttcaagccagctttagctgctgcagattctggcatcacttcgctgacaaaagcaccttgttgtgcattgacatcaaaggctttagctaaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagctaaatctgcattgagttcaccgcctttaataccaagtaagccacgcttcacttctccaaactcaataatttgctgaacaagattgtttgccatattacttggaattgcaaacgcaatacctgcattaccgccacttggtgaaataatcgcagtattgatgccgattaattctccatttaagttaattaatgggccgcctgagttaccacggtttactgccgcatcggtttgaatataactctcatacccttcatcaatatcgcctgttgaacgacctaatgccgatacaataccagatgtcaccgtttgacctaacccaaatggattgccgatagccacagtgaaatcaccaacacgcaatttatctgaatctgcaattttaatttcagttaaatctttaggattttctaattggattaatgccacatcagacattgggtctgccccaactaatttggctttaaattcacggccatcttctaatttaacggtaattttatcggcattatcaataacgtggttatttgtaactacatagcctttcttcgcatcaataattacaccagaaccttcccccttaaactgacgaggagaacctccatctctaaacatatctggaccaaagaaaaattcaaattcttcgggaactgcacgtcttgcggatactttggttttaccttcaatagcaatactgactaccgcaggacgtaccttttctaacattggtgcaaggcttggtaatgcttgtccgtttacagcagtaggcaatgtagcgtgagccgccataggcgcagaaagcacacctaatccgagtactaaagaggttaaaagtgattttttcattgttgctttcattgattatccttactaaattcatgatttatattatttcttatttcaaacccagtgagttcgtattgcctttgactctgattttatttgtcagttctcagttttgtggttaattgtttaaaaatcattctttcagctaattttaatcaatatttgaccgatataattacaaaaatgtgaactacttcacattttatataaacaaagttttgtaggctaatttaccttaaggtaacaaattaatagaatacactgcctttttaggtttaacttatattcaactttttattcacaggatctccattatgttgtggttcttattttgcgtagccgtattaatcctaggctacttcgtttacggtaaaatcatcgaaaaaattttcgtgattaacccgaaaaaaacaacgccagcttacacaatgcaagacggtgttgactacgtaccaatgtctaaaaagcgtatttggctcattcagttattaaacattgcaggaacaggtccaatctttggtcctatccttggtgcgttatacggaccagttgcaatgctttggatcgtattaggttgtatcttcgcaggtgcagtacacgactacttctgtggtatgttaagtgtgcgtaacggcggtgcatcaatgcctaacttagctggtaaatacttaggtcgtccagttaaagcctttattaaccttttagccgttgtattacttcttctagtaggggtagtattcgtagcaagtcctgctcaattattaagtacaattactgttgacgtatttggttcagcaggtggcgcactctctttagataacgctgaagaaattgcgaaaacggcaacggcagcaagcgacattactgtatggggtatggataaaccaacggtaattgcagtttggacaaccatcattttctgttactacattcttgcaaccttacttccagttgataaaatcatcggtcgtatctacccattcttcggtgcgttattgctatttatgtcaataggtatggtgtatggtttagtcacaagtcacttcagtgcaacagaccctgtcgatttcttccgtactattgatggaatgagtgctgagaagttcttccaaaacttccaagttaaaggcgatgttccagtttggccgttactcttcttaaccatctcttgtggtgcattatcaggtttccacgcaacacaaactccattaatggctcgttgtgcagaaaacgaaagcgaaggtcgcttcattttctacggtgcaatgattgctgaaggtgttattgcgttaatctggtgtatggttggtttagcattctatgaaaacccacaagctttacaagatgcaatcgcagcaggttcaccgtctaaagtggtatatgattcttctctttacttcttaggcttcgtgggcggtatctttgcagtattaggtgtggttgtattacctatcacatctggcgatactgcattccgtgcagcacgtttaatcattgcggagttcttcaatattgaacaaagaactttagtaaaacgcttaatgatttgtcttccattatttgctatcggttttatcgtttcaaaaatcgacttcagtatcttatggcgttacttcacttgggcaaaccaaacgacagcaatggtaatgttatggacagcagcggcttacttatatcgctacaataaattccactgggtatgtacaatccctgcggcatttattagtaccgtatcatttaccttcttagcgtacaataagattggtttcggtttagattaccaattatcggtatacattggtttagcattagcagcagcgtgcttagttgcattcttcacaatgattaaacgtgaaggtcaagaagacctggatgtttatattgatgatacaactaaagcataatcattgaattgttgaactataggggcgaattttcgccccttatttttgtggatgaacacagttgctacgaaaaaattaagtgtttgtgcaaatgatatataatactggataagtacagaaatcaaagctctttttttgaaatatgaatttgggcgaatggcacatctagaaaacagacttatcaacagcttactgttaaatacgagttttctcaatgttttttaatccctgtaattcgacaccattcttctttttccatgatagaatcaagtttaaagctattttggtaagcttcacaaacggattctgcttgtgtagcaagaatacctgataaacctaaattcccctgtggttttactaacgtgataatttgaggggcaagttcttttaacgggcctgcaagaatatttgctataacgacatcagcaattaggttttgcggttgatcttttgtaagaaatagttgcaatctatccgctacaccatttacttccgcattgttctgactagctaaaattgcttgtggatcaatatcgatacctattgctttttttgcacctaatttaagagctgcaattgctaaaattcccgaaccacagccaaagtcaataaccgttttatctgttaaatccagactgtctaaccaagctagacaaagtgcagttgttgggtgtgttcctgtgccaaatgctaaaccaggatctagcattacattgactgcatttggatcgggaatttctcgccaacttgggcagatccataaacgtttaccgaattgcattgggtggaaattgtccatccattcccgttcccaatctttatcttcaatttgttctattttatatggaaagtcagtagctacaagtttactttttactaatgtagaaacaatctctttcatgtcagtttctgcatcaaataaggcaacgacatcagtattaccccaaagacgagtttctccaggaagtggctcaaaaattggcgtatcttggctgttcataaaagtcacggacactgctccaatatcttctaaaaaatcgctaattttctcagcttctctatctgtactatttaaacgaatttgtacccaagccattttgttttccttcattttttaataaaatgactattatagccttgcatagcaggagcatacaagattaagtataagttaatccaaatagaactaaataatgtatcttatttgaaaataacaagatcgaatattttggtctaaaaatgtatatttttaaaatttactccagtgatttattactaaatcaacgcatctctatacacatgaattacatatggatatcattgccaccatacgaaattgatacatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattataaccagctcttttgactttgtaagatgaaatgttatgtgatcagtatagtatttagaactaatacattgccataatattgattaatttagtgtagtatttgtagtactctcaccgttttcttccgcttgttgacgagctaaatagtccataaacaatgcatcaaagtttactggtgaaagatttaatgcagggaatgtaccacgatttactagacttgaaattaactctcgtgcataagggtaaagcacttcagggcatttcgctgcaagacagtgtgccaattggataccttcaatacctttgatggtaaatacacccgcttgttttacttcacagatgaatgcgacatcgttgctgtcttccaaagttgtttgaacattgatatgtaaaaccacttcgtaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttcacgcgtttctgtatcaagatcaaaacctaactgaggtttccattcttgatgaaaaatgtttggtaaattaggcgcttcaaaagaaacatctttgatatagatacgttgaatttgcatttcaaacggagtttgttgctcttcagtagcaacttgattttcttcagccatagtcatcccttaattttaatgtattgaattatttatgttttttacaagcggtaagttagctgcacgccagcctgcaatgccttcttttaatacatagactttatcgaagccctgtttcacaagttcatttgcaagcccacttgcacttaaaccattcgcatcaacaacaatcacaggacgatctttatatttttcgatagcctgtgtttttttacctttgatgtcgcttggaattaaatgcacgctctcaatgatatgaccgtgtctaaattcatcatcagaacgaacatcaactaacactgcatcttctttattgataagctgagttgcttgagcattatccacaatcttgaatttgctggttgcacctttatagaaattgatgattaccgcaataaaaagtgccacccacgctacaaccataatggtgtggttagcggtgaactgctgaaattgttctgcaaaagtaagttgttccataggtttctctctaatgtaaatgaataatggtagcgaaagtaactcgccagcgacatttaatataaggcacgctaatgcgtgccaaattattaattagagaaattagccttgatgtgacattacttcatcaaatgaagatgctttttctgtcacttttgcttttgcaagcacagcttcaaccgcttgctcttctaatactacgttacgaatgttatcggttaaacgtggatttttcgcatagtattcaactacttctgctggttgctcgtaagccgatgctaattctgagatggtttctttcacacgagcttcatctacttttaactcattagatgtgatcacgctcgaaagtaatagacctacttgaacacgacgttttgcctctacttcaaacaattctgctggtaattgtgctgccatttctggcttgccaccgaaacgttgaactgcttgctgacgtaatacatcaacttcttccgctactgctgatgaaggaacttcaatgtcgttgtttgctaataagccgttgatcacttggttttttacacgagtagttaatgcattttttaactcacgttgcatatttttcttgatttcaacacgcaactcttcaacggtttttgctgaaccaaattttttcacgaactcttctgttaattcaggaagaacgatgttttctacttttttcaaggcgatagcaaattttgcagctttaccttttaagttctcagcgtggtattctgctgggaatatcacatcgatatcgaattgttcgccggctttgtgaccaacgataccctcttcaaaaccagggatcatacgaccttgacccattgctaatacgaagtcagaagccttaccgccttcaaactcttcgccatctactgaaccaacgaaatcgattgttacacggtcatctgcttttgctgcttcagtggtttctgcaaatgttgcttgttgtttgcgtaacacatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccattttgtctaaatcagcttctgtgatttcaaccactggtttttctacttcgatgttttctaaaccttttaattcaacttctgggaatacttcaaaagtcgctacgaatgagaaatcttgacctggttggtagttgtttggtgtgaatgttggacgacctgcaaggttgattttctctgcaattactacatcaaagaaagcacgttgcatctcttcagataatacatcttgacgagccgctaaaccgtaacgttgttcaatgattgagtgaggaactttccctttacggaaaccatctacacgagcatttttcgcatagccttttaattgttctttgtaacctgcttcaattttatctgcagctacggtaactgttacacggcgttgtaagccttctaatgtttcaatagaaattgacattcttaaacctcagtattaaaaaggatttgattataaaatacaaatagatagcaattgtaacgtcctgtaaacacaatgtcgagaactttagtgattgaaataaaatatacgaacactcaataattaatatacttttattgtaggaataatttattcaatgtgaataaagcatatgcttaccaataagcatactgtacaaattctttataccgactatttctctaactaaagagaaataagcacaataaatgatatatctcccttagggttaatttactcacatcccaagaaaagtctattttcaatagctaaagatatttcaaaaatggagtttattgcgtttcatgtaagtacaaataaatattaaatctctacaataacaaattatttcatttatccattttattttctcccaaactatgttctaataccccccaacaacatttccgtaacatttgtattaaggtttaatcaatgttcagtggtctttttatcgggatacttctcggttttttcttacaacgtgggcaattttgcttcgtgtccggttttcgcaacatttatacccagcaaaactttcgcttttttaccgcattgttaattgcggtgtccattcaatccatcggatttttagtttaagtgaattagggctgatcaccattccgaataccccaatgcctctgttagcaacggtgttaggcggttttgtatttggtatcgggatgatcttggcaaattgctgtgccagcggtggttggtttcgcaccgaatttttaccaaacactggcacccttttgctaccgccgtgtgtatcggcctgctcggcgtgttggcgtggtttgtgagtgagcagtacggcagagcttacggctatggtgtcgctgtgccgaccgccaatgtggtgcaatatatcgtgatcggacagcaacgttatctcaactggggaacttacttcgttctcggcattttgctcggctcttttattgccgcaaaattgagtggggaatttgaaatccgtgtacctgaacccaaagcgattatgcaacgaatgttcggcggtttcctaatggggatcggtgccagccttgcaggcggttgtacgatcaccaactcactggtttcgaccgcttattcttcgtggcaaggttggcttgctacgctgatgattatgctcggctgttggactgcaacttactttattaagccaacgcaatgtcgtatttaatttaataaaccagcctaaattccctcccccgtttacgggggagggttaggcccctgtgtataaccttgccaatccgcaacaaattgaacaaaacctgttacaacacgggatcaccaaagataaaactattgtgctttattccgacaatccgcttgccgcctatcgtgtgttttgggcgttgaaatgggctggtgtagaagatgtacgagtgttaaacggcaatcttgccacttggatagacgcaggttttccaacggaaaccaaagtcaatcagccactgcctaaaacggcgttcggcacaaccattccggctaatccgcagatcaacatcagcccaacctgagcaggcttacgcccgtctgcaacaaggcttgaagctcgttagcacaagggcgtgggaagagtttatcggcgaagtgagcggtgatgaacatattcaagcaacaggtgaaccgcagggagcaatttggggcttttcgggatcggcaccgtcaaatgtcgccgatttttacgaccctgatgacaccttgcgtaacccgaaagagatcgtggcactgtggcaaggacagcatattcaacagggcgatcaactggcgttctattgtggaacaggctggcgagcgtccgtgccgtggtttatgacccagcttctcggctggcaaaatacggcggtttatgacggcggttagaatgcgtggcagatggactcaaccttccctgtacagaaaggcgcgccgaataatatggcgaagccggatagtaaaaactaacatataaccctcgtaagcagtcagtttgttgcaataatttgtcataatctgaccgcttatatttttcgttctattgcttcgctatataaaaatcatattaaaataaaagaacttttcttcctagattacagtcttagcagcatatcttttatttttggagagcatgatgaaacgcactacacttacaaaccatcaatttttatgtgccagaagcctattttaacggcggttcaatcaatggatttacggctaacgccgcaccgattttcttacctaatgcggttgggggttatatgcctgccaaagcagcaacctatgataaaaaaggtttcggctcgaatgcagataaaccgaatgcaatcgtaacagcactctctaaaggctatgtggtggcaagtgttggtgctcgtggtcgaacccttgagaaagacggcaaatatacaggaaaagccccagcagcgatcattgacttaaaatcggcggttcgttacttgcattttaacgatcaacgaatggcaggtgatgcgaataaaattatctcaaatggaaccagtgcaggcggtgctttgtcggctctactaggggcaagtggcgatcatcgcgattatgcggaatacttcaaacaagttggggcggcagaagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgatgcgatttttgctgtatctgcttactgtccaattaccaatttagaaaacgccgataccgcttatgaatgggaatttaatggcttaaatcaatttagtcgcattgatatgagccgtttatccgcaacaggttacaatgatcgctctcagtcaaaacctcgcattgaaggtgaattaactgcagatcagatcaaaacttctcacgaactaaaagccgcatttccagcttatatcaatagcctgaacttaaaagatgaaaaaggtaattcgcttacccttgataaagaaggaaacggctcttttaaagagtatgtcaaacaggtgatagtgagagctgctgatacagctcgtaaaaatggcacggatttaagtgataagtcgtggctcactttgagtaaagatggtgtggctgatatggattggaacggctatattcattcagaaaaacgaatgaaatcaccgcctgcctttgatgcctttgatttaagctcaggggaaaataatctctttggaacggaaaccgttaataatcaacattttaccccttacgcccttgaacgtagtaccgcaaaaggcggtatggttgatgctcatattatcaaaatgatgaacgcaatgaactacgttgaaaaccctaaagccgcagaacattggcgtatccgtgtaggtacttcagatcgtgatacttctcacgcaatcggtgcaattttagccattaagctcaatatggcaggtaaacaggtcgattatgcaaccccttggggagttccgcacgcaggggattatgatttagatgcactgtttaagtgggcggatagtattgcaaaatagcgtattttaaatagactaaaagttgctaaccattgtaaaagcaaaggctagcaactttttctcacacatattgatgttattacgtatttttcatcaatcgtgaaattctcccctcaaaaatttcctcatcacggattgtcataacctcgcagccatcttttgtaacaacaatttggtgttcatattgtgcagaatgactacgatctttagtttttaccgtccacccatctcccatcaggcgtatttcctttttcccagcattaatcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgatttaaacgaatacctggttttaccgcacgtaagccaatataaagacattcttgagtaacctctaacaagcgcttatctttaatcgttggctctcctacagcatacatttttgaattatccccataatagccatcctttatcacagtcacatcaatattcagaatatctcctttcttcaatttcttttctggatttggtatgccatggcacacaacttcattcaatgaaatacatgttgcttttggatagccatgatagcctaaacatgcgggaattgctttctgtacttgttcgatatattcatgacaaatgcgatctaattctccagtactaattccttctttaacatagggctcaatcatcactaaaacatcagaagctaacttacaggcaatacgtaacttttcaatctctgcctctgaacgaataggtatattcttcatttttacatctctctacaattaaataaaataaattatatcctctttagccaaataattcactccatataagtaagcattaccttaatgaatatctatatttgttactcaaccgtcactgacttcgccaagttacgaggctgatccacatcagttcccttaatcaaagcaacgtgataagaaagtaattgtaatggaacagcgtagaaaataggagctgtcacatggtctactttcgggaaagttaataccgtataaccttcttggctactaaaccctgcttcactatcagcaaagacatacatttgaccgccacgtgcacgcacttcttcaatatttgattttactttttcgagtaaatcattttctggtgcaaccacaatcacaggcatatccgcatcaattaatgctaacgggccgtgtttcaattcgcctgccgcataagcttccgcatgaatataagaaatctcttttaattttaatgcagattccattgcgataggatagaactcaccacgacctaagaagagcgtatgatgtttctctgcaaagtcttctgataatttttcaatctctttatcaaatactaatgcactttcaatttgtgctggtaagcgttgtaaagatttcacaatttccgtttcttgttcagcagagacattgccttttaaacgtcctaatgctgccgttaaaagtagtaaacaggttaattgtgttgtaaatgctttagttgaagcaacgccaacttctacaccagcacgggtcataaaagcaaagtcagattcacgcacaagggaagagcttgccacattacaaatcgtcattgccgccataaaaccagattctttggctaaacgtaatgccgctaaagtatctgcagtttcgcccgattgagaaatggtaattagcaaactatttggacgagtcacaaatttacggtaacgaaattcagaagcgatttcgacatcacaagccacgcctgcaatagattcaaaccagtaacgagccaccataccagcattgtaagacgtaccacaagcaacgatttgaatgtgttcaactttctttaagatctcttcagcattgttgctgattgcttcaatatttactttaccgttcgcaatacgtccttctaaagtattcataattgctactggctgttcaaaaatctctttttgcatatagtggcgatattgacctttatccgctgcatcagactcaaagttaccttcgtgaacgtcacgctctactttttcacctgcacgattatagatatcgacagtacgacgagtgatttctgctacatcaccttcttcaaggtagataaaacgacgagttacacttaataatgcaagcgggtcagaagcaaggaaattttccccaacacctaaaccgatcactaacgggctacctgaacgagcaactactaaatgctcaggttcatcttgattcattaccactgttccgtaagcaccacgaagctgtttgaccgcttttcttaccgcatcgagtaaatttggcgttgtacggaattcccattccactaaatgtgcaattacttcagtatccgtttgtgattggaatacataaccgcgttgttgtaattcagcacgaagttcttcgtagttctcgataataccgttatgaacgacggcaattttgcctgaacggtgtgggtgagcattaacttctgatggctcaccatgtgttgcccaacgggtatgtgcaatccctgtgccgcctaaaagtgggtttgcttcaagtgcttcatctaagaatttcactttacccacacggcgaacgatctgtaagttatgatcgtttcctaagactgcaacaccggctgagtcataaccacgatattctaaacggtgtaaaccatcgactaaaatttctgcgacatcacgttgtgctactacacctacaattccacacataaatttactttcctattttgttgcttatgttgtttattttgcaacaatcacctcaacccctaacgcctcaatttgttgtttgacgtttggatcaagctgatcgtcagtaattaatttatcaatttgttgccactccaattcaagatttggcattttgcgtccgattttttgagattcaatcatcacaataacttctcttgatacttcagccattacttgactcaagccaataagttcattaaaagtggttgtgccacgggttaaatccagtccatcagcaccaataaaaagctgatcgaagtcgtaagaacgcaatacatttgcggcaactttcccctgaaacgactccgaacgagcgtcccaagttcctcctgtcatcaggactgtcggttcgcactctaaggcgattaattcatttgcaagagcaagcgaatttgtcattacaaccaagcctgaatgatgaagtgctttgactaacgttcctgttgtactcccgctatcaataataatgcgattatgatctcgaatttgatttgctgccgcactagcaatagctaacttttgtttcgaaagttgctcttgcgattcttcattcatctctgttggtaattttattgcacctccgtagcgacgcaataaaaaaccgctttcttcaagagcggttagatccttacgaatagttacttcagaggtttcaaataaatgtgacaaatattccacacttacttcaccttgttcttgaacaagacctacaataatttgacggcgttgttgtgtatttcgttttgacacttaaattttccaaatatctttcgattcaaaatatgattattatatagaggaataattagcaagagaagtaaaacttgtagcatcattctgaatgggagaacactgtaacatctataattaacaaatatcttgcatctataaaatgtaaaggaatagattgaaacctaaaataccaatacccacactaaatagaacatttcttaaccatacatagctcactactactcctactaatgctattatttgagcgataaataaggtataaccttcattacttttcggcaaacttaagctggtgagtaccagtaataccataatcacaagcggtaacattttgtttaatttttgcaaaattggcgaagatagtacagtttttggcaaaaataacggcaaaaagcgacaaagttgagtgcctaatgccaatgcaatcaacatataaataatattttgcgtttccattaaacttgtccttttttctcagtgaatgattggggtaagaaagcgacaatgataatggcgatgatgattgccacaagcaagacgcttgtttgtgtgatttgccctgcaagtaaaaatccaatcaatgcaataaaaattggcttccactgcttttggctactgtattgttcataagctaaaatagcgaataagcaaggcagtgcaaaatctaaattgggaatatattgggaaacagaatcacccaataaaatgccaacaatagttgcaaatgtccaataactcattcctaagatactgattttgaacatcatcgcctgacgagtttcttgtggtaaggtggttaatacgccaaagttttcatctgtcagatagcttaatacaaaaaagcggttgagtttttctttgggtaatgatgaatgcatattaagtgtataaaaaataaaacgtaagctcatcaataaagtactgagaaaaacggaaactactcccgctccagaaacaaaaaagggaattgctgcatactgtgctgtgcctgaaaaaacggtaaaacacatcacaattgtaaaccacgcaggcattcctgcattggttgctaacattccataggcaatacctgcggcaaggtatcccataaatattggtatagtgagtttgaacgcacttttccaactattttccgtgttaaatgacataaagctccagcgtaaatttatgcaatgagtgcattttcaaaaaaatacaaacactctcttataacataaacctttataccaaatattaagccagaatataaagaggaccttttactccacaagatgttaacccgattattatcaggaagagcataaatatcagttttttcattatttatgtatgtattgttaattacgttgggtaaatgttacgttagaatagtataaaatgcaaaatcttttaagagagatgttgccgattgggtattcagcacaacaacagaataaaccttaccattacaataattgatatgcttgaataccacaacttctcccgccctcgcttgtctttcgcatactaccgaaacataccaacttaaactgctttttatcattgaaatacctattaccaactttttgctcttatattcaagattatttacgacactgatttaaaatatctaactctttctgataaacagagagcgataaatccatatccatcatacctatcacagaatgaaaataattgtcatgagaataggtttttgttttcgcattttctctaacgcaatttagatcaaaaggttcgtttttaatccactcttttgaaaaccacataatcatcgggactttggtttgatattcaggtgcaatagaataaagccaagggataagtttaattttgttcatagaaaggatttccgaaaatcaggcataaaaaagcggtcagcttctgcaaattttttacaaaaacagaccgctagtgaggataaattatttcttagtaatctgttttacatccacttgaactttgttccaatcgttatcaactttaccacgaatttgaatggtatcttgaggaccgatatttaaaccgttccaagcacgtttgcttacatcaatttcaatttcgcccgttgcgtctttaaagataaactcatctttgtcgatttgtttaacgatttgcccttcaagtagtgcaggggtgtcatccgccgctttaagtgcatctgctacgctcttcactgcaatactttcatcaaagaaaccctgtgattgatgtgttcttgctttgccatcgtgatagccaccgtgacgataatcatcatcaccttttgccattgatacagtagataccgctaataatgttgttaagataattgcttttttcatagaatactccgaatagttaaaataataagtatgaataacgaaggctcttgcctttcgttgagagtattaaagcaagtaaatcttaaaaaattcttaagaagtaaaaaattttttatatctttattgataataaagatatctaatctctatttacattatgaattggaatcgactagagaaatgatatacaaaagtactagaagaatactactattgcctttttgaggcccaataaagggagaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagttttagtattgaataaatagaataaaatcaagttacgcattactataaaccgtcttttcatcaagccaacggcgaattagctgtttagctgtatcgggatattttaacgttagctgtttagcgtagctctgcaccaacgggatcatcttacgatctcgcattaaatttgcaatcttgaactctgccattcccgtctgttttgtgcctagcacttcgcctggtcctcgaatttccaaatctttttcagcaatcacaaagccatcttggctatctctcagcacctgtaaacgcttagttgaaattttacccaatggggctttgtacatcaagacacaatgggaagccgtcgccccacgcccgacacgcccacgcagttggtgcaactgtgccagccccaagcgttcggaattttcgataatcatcaaactggcattcggcacatctacgccgacttcaatcactgttgttgcgactaacaaatcaatatctgccgccttaaattccgccataatcgcctgtttttcttgcggtttcattcgcccgtgaaccaagccaatccgcaaatctggcaaggctcgttgcaaatcttcggcaatcgccgctgccgcttgtgcttccaatacttccgactcatcaattagcgtacagacccaataggcttggcgtttttcatttttacaggcttgataaacacggcgaaccacttcatctcggcgatcttctgaaatcgccaccgtcgtaatcggcgttcgccctgggggaagttcgtcaataatggacgtatccaaatccgcatagacagtcatcgctaaggtgcgtggaataggcgttgcggtcataatcaactggtgaggatagacatcgcccttcgcccctttctcgcgtagggttaaacgctgatgtacaccaaagcggtgctgttcatcaataatcacaagagcaagatgatgaaattccacctgatcttgaaacagggcgtgcgtgccgataatcatctgaacatcgccgtttttaatcgcttccaactgagctgttctcgctttacctttcactttgccagctaaccagcccacttcaatcccaaaaggtcgcaaccagttggcaaaattgtgagcgtgttgctcggcgagaatttcggttggtgccattaacgccacctgtttaccattgtcaatcgccagtaatgccgccaacgcagccacaagagttttgcctgaacccacatcgccttgcactagtcgcatcatcggaaaaggttttgccaaatcctgttcaatctccgcagtcacacggctttgagcgttggtcggttgaaacagcaaagtggctaaaaagcgttgttttaaatcggtttgataacatagcggttcagcaaaatgttgttgcacccccattcgcacctgttgcatcgccaaattatgagccaacagctcttcaaaaatcagccgtttttgtgcagggtgttcgcctttatctaacaattcggacgacacactcggcggcggtcgatgcaacaactgtaaggcttcttttaagctatatttgtgtggattaaattcatcaggaagcaattctgccacttgcacacgctcaagtaacgctaaggcttgatcggttaatttacgcaaagaggcttgcttcaagccttcggttgtcgggtaaatcggtgttaatgtttctgccagctcaagcggttgatttccccgaataatttgatattcagggtgatgaatttctgccataaagcgaccacgtttaatctcgccaaaggctttcactcttacgccagttgccagactatttttcattcccgcattgaaattaaagaatttcagggtaattttgcttgtgccgtcagaaattgtggtacttaaaatcggacgacgaccaaattgcacttccgtcagttgcacaaagccttcaaccgtcgcaaaactttcaggacgaacatccgcaatcggcgtgatccgagtacggtcttcatagcgcataggcaaatggaacagcagatcttgcacattattaatgccgatccgactgagtttctctgaaatcgccgccccaacacccgaaagggcggttagcggtacaccgtctaatagttgttggttcattgcaaaatggttgtggaaaataaccgcttgattgtatgctacatagagagggctaaagtagcccttaggaacaaaaaataaagatagtccctagtatgaatagagaaagaaattattttttatccatcaacactacccaaccactagctaaccaatcacaaagtgtatcgagtaagagttctaattcatcttgattttcagccttagaagcaagtttattccacgaaatcgcatcaccgttggcaatacggattaacaaattagcttcggcttcattaagttcatcaatccactcaccattgacataaacgcgtaacgggttctcagtataaaggattttaacgttcgcatcttgttgtacccaaccacccgcttctagcacctcctgtacttcgtcaggataaaactcgttgtcttcggttaattgttcataacgacgcgtactcacggcagtagcaacactatgcgtaaagatttcatcaaactgagtagagttttgcaataagtcgatcaaacgtgcttttaatgtagcaaccatttttggatcaagtaaggcgttcggttgcatatttggcgacaaacggaatgggattgcaaattgtgaatttgggataatttccccttgatgttcaatggttttacataggttttcaagtaaatctgtagcattagggaaacgtaaaccaaaagagaaagttaagcagtcatcttgtgctacgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatcttgtgctacgccataatgagaaaggcgtgacggtacataaagtacatcacctggtgcaagcacctcatcaaaaatcaattcgcccatatcatcaaaaatacggataggttggtttggtttaaattcagtgctagggtcgcaccatttgcctaactgccaacgacgatgcccatagccttgcacaaggaaaacatcatattcatcatagtgtttgccaacagaaccgccagcaggagcgtaagaaaccataatatcatcacgttgccattgtgggatatagccaaatgcttgccataatgcaccaagttctggcgaccactgttcaagattttgcactaatacagaccactgctcaggtaaattttcaaaatcttcagccgataacggactacgcttgagcgaccatttctcaccttctgctgtttgatgtgtttggatcaaacgagaagttacttccccttcctgagctaattcaataatgtcttgaggctcaaacagccccacaatttgtggtaatccattacgaattaaaagcggtcgtttttgccaataattttgcaaaaagtcttcagcagaaatattttcaggtaagcagaatgggatattcataggcagttccttatattgcaatctaaaatagcattttaacaacctatggcaagatttccaaacaactctatgcgattattcacaagttttagttccttggcattttgtagatatttcatctaacaactccctgatttttttccagatataattgctatccatttgtttaatctggttatagatagattgttctagaatgtattctgatgagtgtagagtatctcttatgatatattgctcataaatttcgggctgtaattcaaagtgaacaccagagagcaagaatttacctttaccataagatccacaaacaatggctgggcgatttgcagaatagcaagcaaccacagtctctgcatcctctgcttcactcaaaaacactggacctccatgataataaaagctcaattgagtgttattttgaaaagttaatgttgcaaaggtttttgatacagctgttccatcatagtagtactgattagtcaaatccggcaatgaaccaacagctttcccgttaaaaagcgctaattccctgttctcaaaaatttgataaccatctccagtaaattcgatggtctttgttgcataataagcaccggcacaaattccaagataaaaaccaccacattgtacaaactgccgaatatgttggttcccttttccatttaattttgcacaataagggagatcagcgccgcctggcataatcaacatttgacaatgttctagctcattatcaataatgtgctgtgcagtaatagtttttgtgggtaaaccaagatttgtagcaattgcaagttgcaaagatgctacccctacatcactcaccccatcatctacataaatacaaactggttttaccatcttacttattgccctaaaacagttactttttagtgtaagtctagtataatctgaacccattttccaatttaaaggaagtaactatgtttataacacaactttctcagactaaaaaatggttagaggcaaaccaatctctttcttttattttgaaatctcttattggtgcaaatcttattgcggtttttgctcaaatttctgtgccaatgtatcccgttccaattacaggtcagacgctagcattaaccgtagttggttttgcattggggcgtaaagctgctgtttctgcagtattactttatttatttgaaggtgtgattggtttaccagtatttgctaatggtggatctggatttcaaacgttattaggcccaacgggtggatatttaattggttttgtaccaacagcttatttattaggatactttagtgataaaggtattttaaaatctttctggaaaagtgttgtggtagcattagctgcgactgttattactttcgtttttggactagctcaactttcactttttgtaccaagcgataaagtgcttgaattcggtttatatccattcattattagcggagttattaaggctgtacttgctagcttgttggttattccgtcctataaattcttttcaaaattatgattgcttaactgctccgcaaggtcagcttaatatttctagttaagcacaatagacaaaagagttcgtgttaattgttttctttattaccacaaactctttttgtttacattcgttaaacactctcagcaagttaaatcacccctaacttttctaaagccaccaaaataccatcttgttcaatcggcaaagtgacataatctgccactgctttcagttcatcttccgcattgcccattgcaaccccaaagcctacggtagcaatcatttcaaaatcatttaaaccatcgccaaacgccatcgcattttcaataccaaagccaaaatgattgagcacatcttgaataccgcatgcttttgagttatttttatttaacaaatccaccgaatatttatgccaacgcacttcttttaaatcatcttctaaaattccagagcgaataacctcttccgtgcgttcttgtggaaaaaacaccaatagttgaataaccgagtgatccaaataaaaattcggatcgacaatataatcttctttaattggacgcaacgactcttcaacttccgccgtatttttagacaccgcaatttgttctgctgtcacaaaggcatactcaatctgcaacgcctgcagtttggctaatatacgctcaatacgttcagttgttagcggatattcactgataacctgatctcgataaaggttatattgtccgtttgtcgtcacaaacagatcaaaacctttttcattcattaacggcttgattgctttaggaaaagccccgtaagttctgcccgtggcaatcgcagggataatccctttagctcgtaaacgaggaagtacttgctctgaaatagacagcggaatacgggtttcttttttgtaatataaggtttcatcaatatcaaaaaacacaattttgattggggcagttggcttttgcataatatctccttttatgtttaatctgtgaaattttactcttttttcgatctgcgtcacaaaaattcctcaaacttctcttaaaaaacttgatagagttcaaagaaaaaagttattgaggaaaagatgaacgactggggatttcgctgtatacattgcgacagacggcttgccattgcatcgcacggtatttgtagccgttgtaatgatctgctaaaacgccactgctactgtggtggctgtggaagttttctgctaagcgatcacaattactgtggaaattgtttaaagaatgaacctaaatggcatcgcatcgtgcaaatttcccaatataaaccaccgcttgcagaatggatccaccgtttcaaatttcaacagcaatattggcttgatcaaccgttagcacggctgctactacttgctatttatcaagctagacgaacacatcagctcacattacccgaagtgattttacccgtgccgttatattggcaacgtgaatggcaacgagactacaatcaagcggtgcttttagcccaacagttagcaaaatggcttcttctgccaatggataaagagagtttacaacgtattcgagccacccaaccgcaacgagagctaacaggccaagaacgtcgtaaaaatctacgaggggcttttatttatcaaccgaaacagccttatcaacgagtggcgattgtagatgatgtggtcacgactggctcaaccttaaatgccatctgtgctgaattactcaaacagggggtaaaggaaattcaggtgtggacgttagcgagagcctaaccaaaataacctttcacttgtctgccaaatagtttcggcaatctgctcaggcgtttcacgacgtaattcgcataatgcgttgaaactgacaactaaacgctctggacggttcggctcgccttgataaccaaagacaggcatatcaggggcatcggtttcaagtaacaaactttccaaaggcaatttacgcattgtttctctggttttatttgctctttgatagcttatcgtaccgcccaccccgattttataacctaaatcaacaaaacgcttcgcttgttcataacttcccgcaaacccgtgtacaacacctgttcgagcaagttgtgcttttttcaaaaaagtaaaaagctgatcgtggcttttgcgagagtgtaaattcacaggcaaatcataccgcttggcaaaagctaattgtgcttctaaaaatgcacattgtttatgccacagctcaggcgtacaaaccgcttcaactgctcgctctaagccaatctcggcaattgccgtgcaatgcggatcttggcgttgcagatagttttcaagtaaatccaaatcggctgtttgatgttcggcaatataaaggggatgtaagcctaagccatacacaatatggtttggttcagcttggctacaagcggacacttgctcaaaattttttgcagaaattgccacaactaaaattcgttccacctgttgagctttagcattatgcattaattgcgaaacagacagattgagatcttgagcaagatagtctagatgtgtgtgagtgtcgaaaaaacgcatattcaccttcgctcaatacttacttttactcgattttctatttatggacttggttctcgcattttttatcttaacttccttaaacaccggcttttccgctttcgcttttttcttcgccgttttgccttcaccacgagctttgcgtaagctggtcattaaaacaaaatcaatttttttatcgtcaagatttaccccgatcactttaaccctaacaggatcgcccaagcggtacattacgccgttttcgccgacaagacgctgacggtcgctgtcgaaatggtaatagccgttatctaaggttgaaatgtggactaaaccgtcgatcagcagttcgttgagttttacgaacaaaccaaaacccgttacgctggaaatcacaccgtcaaacacttcgccgatatgatcttgcatatattcacatttcagccaatcagccacttctcgtgtagcctcgtccgctcggcgttccgttgcagaacatttttcaccgaaaatatccatatcgtcgagctgatagtgatagccaccgccatcggtatagtgacgcttattgccttttcctttctcaatcaaatacttaatggcacgatgtaataacaaatcaggataacggcggatcggcgaagtgaaatgggcatattctgtcaatgccaaaccaaaatgcccttcattatcaggagaatagaccgcttgtttgagtgagcgaagtaacattgtctgaattaattcggcatcaggacgttctttgacctgttctagcaattcggcgtaatcttttggtgttggacgcaaaccgccatttaagaataaaccgcactctttcaagaaagtacggaaactggtgagcttctcttcgctcggttgagcgtgaatacggaataaggcaggttcatttgcttcttccacaaaacgagcggaagcaatgttggctaaaatcatacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttcaatgattttatgtgcatcattgcggatcacaggctcaatccgttcaattcgcccttgcggattgaaaataaattgattttccaccgtttcaaactcaatcgcaccacgttggtgacgagtattcagcaacactttatacattgcgtgcaactcttccaaatgtggcacaagatagaaataacgctcacgaagtgcttcgtcgccttctaaaatgttccacactttcgtataagttaagcgagcgtgcgagttcattaccgcttcatagaatttataacccagtaacttaccgctttcagacaccgccatttctgccactaagcagagccgatctacctgcggatttaatgaacataacccatttgatagcacttcgggcaacatcgggatcacacgattagggaaatagaccgaattaccacgctgttgagcttcaagatcaagggcagtttttgggcgaacatagtaactcacatctgcaatcgccacccacaaacgccagccgttactctctttttgacagaacaccgcatcatcaaaatctctcgcactttcgccatcaatcgtcaccaacggtaagtcacgcagatcgacccgaccgattttggcttcttcaggcacttcttcactaaattgacgcacctgtttttccacaccttcaggccaaatgtgcggaatatcgtgattacgcagagcgatttcgatttccatacctggtgcaagattatcccctagaatttccgtaatcacaccaacagggcgtttgaaatctgctttgcgtggctgaagttcaaccacaaccacttgccccattctcgcccctagacgatgttcttcagggatcaaaatatcctgattgatacgactatcatcaggcacaacataattaataccgctctcggtaaaaaaacgtccgacaatctgctttttacgcgcttcaagcacacgcacaatccgcacttctttacgcccacgacggtcaatcccattcggttgagccagtacaaaatcgccgtgcatcacacggatcatctgactattcggaataaaccaatcatcatcgccttcaacttgcaaaaagccgtagccatcacggtgtccaatcaccgtgcctttgattaagtccattttttcaggcaaggcataacgtttcttcttagtaaagactaactgcccatcattttccatcgcacgcaaacgacgacgcaccgcttcttgacgttcttcatcataaagatgaaacgcttcaagcaactcttctctgctcataggagcgtcatagtcacgaatggtttgtaaaataaattccctgctcggcacagggttctcatatttctcgagttctttttggtaatttggatcaacgatcattctattgttctctttataaaattatataacttattgtttttattattgaaatgtaaattcagaagtaggttcggttgggaaatgaatttagatcagataatttgatctggggggattttaacacagagaagaggttttgtacgaaaaagatctctgttcttctttttataataaaaacaaagggttaattctttataaaaataacaaaaatttgatctagttaaaacctaccacttccatcttcaaattcaactagatagaatttatcctgttttattattacttaacgaggtttgtatgctctattttgagtttttactattattagcgtttctctatgtaggcagccgttttggcggtatcggtctaggggttgtttcgggaattggtttagccgttgaagtatttattttacgtatgccaccaggtaaggcacctgtggacgtcatgttaattatcttagctgttgtaacctgtgcatctattttagaagcggctggcggtttaaaatatatgctccaaattgcagaacgtattctgcgtaaaaatccaaaacgtgtcacacttttaggtccaattgttacctatatcatgacatttatgcttggaactggacactctgtatattcagtaatgccaattattgcagatattgcattaaaaaataaaatccgacctgagcgtccaatggctgcggcctctgttgcatcgcaattagctattacatcaagcccactttctgcagcagtagtattctatcttgcacggattacagaattaccagggcttgaaaatgtaaccttacttaatatcatctctgtaacagttccagctacttttgcaggtacaattgccttatcactatatagcttacgtcgtggtaaagagttagaagatgatccagaatatcaacgccgtttacaagatccaatctggcgtgaacgtattctaagtacaacaagtacaactttaaatgatgtattgccagctggtgctaaaaccgcagtattgttattcttactttcactaatcaccattgttgtaatcgcaatgttccctgaaattcgtactgtggcaacaggtgagaaagtaaaaccaatttcaatgtcacttatcattcaaatgatgatgctctgctttggtggtttaattcttcttgcaacaagaactaatccacaaactgtgccaaatggcgtggtatttaagtcaggtatggttgcagcgattgctattttcggtattgcgtggatgagtgatacttacttccaatatgcaatgccacaatttaaagcaggtattactgaaatggtagaaacctacccttggacttttgcattagctcttttcgcagtatctgtggtgattaatagccaagcagcaactgccgtgatgatgttacctgttggtatcggcttaggtttacctgctccattattagtcggtttaatgccagcaacttacgcttacttcttcattcctaactatccgtcagatattgcgacagtaaacttcgatgtaacaggtacaacgaagatcggtaaattctacttcaaccatagctttatggttccaggattaattggtgtacttgtcgcttgttgtgtaggcgtggcaattgcgaatgtagttatttaatcctacataatgtgagaagtcgtgcggaatatatgcattatatattccgcctatttttatcaaaaaacataaattcatcggttctcttttaatctatttttggccagaaaaatctacaagtatttgagaaataaattatttaatccataaaaatttcaagatcttgatcattttttcgggtatgataacgatcttctcaaccctattaatttggagcaaactgtgtcttccctttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgattgtttaactcacttacaagcaaaagtatcgccaactgattacagcacttggctacgtccgttgcaagcgagtgcaactagctctgaattagtgttgtacgctcataatcagtttgtagcaacttgggtgaaagataaatttttaggggagattgttacccttgctcgatctttaagcaaaaatgagcagttgcaagtggagatccgagtagggatcaaaccagcagaacaagcggtgacttctgttgcaccaactgcaacgccaccgcaagaaacgcaagctactgcattacgttctggacttactgaaacgctcacctttgataactttgttcaagggaagtctaaccaactcgctaaagccgttgctcaacaggttgcaagtaaccctggtgaaagccactgcaatccattttcgttatatggcggaacaggtcttggtaaaacgcacttgttgcacgcaatcggtaatgaaatcctaaaacaaaacccgaatgcgagagtggtttatattcactcagagcgttttgtgcaggatatggtcaaagcgattaaagcgaacaccattgagaatttcaaaaaattctatcgctctcttgatgtgttgatgattgacgatattcagttttttgcgaacaaagaggcaacacaagaggaatttttccatacctttaactccttatttgaacgaagtaagcagattattgtgacttccgatgtatttccgaaaaacattgagaatatagaagaacgtatccgctctcgtttaagttggggggttaatgcggcgattgaaccgccagagctagaaactcgtgtggcaattttaatgaaaaaagcggaagaacgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagatgtcgcctttttcttagggcaaaaactcagaactaacgtgcgtgaattagaaggggcgttaaatcgtgcaattgcgtggagcaatttcaccagccgtcagatcacaattgatgcggtacgagaagccttaaaagatctgattgcctcttacgatcacttaattaccattgagaatattcagaaaaccgtcgctgagtattacaatatcaaaatggcggatttaaaatcaaaaagtcgtacgcgttccgtggctcgtccacgccaaatggcaatggcattagcaaaagagctgactaaccacagtttgcctgaaatcggacgtgaatttggcggacgtgatcacacaacggtgatgcacgcctgcaaaaccattaatgagctgagagatactgataacagtatccaagaagattacaccaatttaacacgcaaattatcgtcttaaggaattgttatgcaatttactattacccgtgagcagttactcaagccgttacaacaggtttgtggcgtattaaccagtcgtccaacattacctgtaatcaacaacattttgctagaaattgaaggaagccgtttatctttaacgggaactgatttagaggtagagcttactacccaagcggagctgtttgaagcggtcagtttctcaggaaaatttactattcctgcgaaaaagtttttagatatttgtcgtagcttacctgatgatagcgtaatttcggtgcagtttgatgaagatcgtgtctttatccgtgcagatcgcagtaagttcaatctagcaaccttacctgcttcggattacccaagtttaatggactggaaacctgaagtagatttcacgattgaacaagcgactttagctcgtttaattgaagcaacacaattttcaatggcaaaccaagatgcccgttatttcttaaacggtatgaagtttgaaactgaaggcaacttattgcgttcagtggcaacggacggacaccgtcttgctgtatgtacaatggcattaaatcaagagcttttaacccattctgtgattgtgccacgcaaagcggtattagaattagtccgcttggtgggtcataataacgaaagtgttcgcctagaaatcggtacaagcaacttgcgtgtatcaatgaatggcattgtatttacatcaaaactgattgatggacgtttccctgattaccgtcgagtattgccacgcaatgcagatcgtattttagaggcagatgctgaagtgttaaaacgtgccttagtgcgtgcggcgattttatcaaacgaacgcttccgtggcgtgcgtttagccttaaatcaaaatctgttaaaaattacggcaaataacccagagcaagaagaagcggaagagatcattgatgtctcttatcaaagtgcagagatggaagtaggctttaatgtgagctatctgttagatgtgctgaatacattaaaatgccagcgtgtacgtattagccttgtagatgcaagttcaagctgtttaattgaagattgcgataatgctacggcggaatatgtgattatgccgatgagattgtaacttcagatgtagttatatttggagaaataaaatggaatacttagccccatttattcaaattgtggttggcttttttagctttatgttagtgttgcgaacttggctacagttctgtcgagttgatccttatatgccgatttcacaaacgttaatgcgtttaaccaaccctgtgttaaacccgctaagcaagctgatcccaacggtaaaaggaattaattttgctgcgttgcttttagctgcagggattgtggcattacaatttgtgttattcggtgttgatgtaccaagagctgtgcttatcggcttattgagtatcatcaaaatctttgggcaaattctcttttttaccaccttaattcgagccttaatgagttgggtgacacagggaaatcacccgttagattataccgttgcccaaattactgagcctgtactcggtattatccgtaaaattttaccaaaaacaggtatgttagacttctctgtaatggttcttggttttgcattgctctttattaatagcttgttttaccaagtctttggacaactatgggctgtggcataatgcaagcggtcgaattttgtgaaaatccgcaaggtatccgcttgcggatttttttacaaccgaaagcaagtcgagatcagattgtcggtttacacgataacgaactcaaaattgctattaccgctccacctatcgatgggcaggcaaatgctcacttgctgaaatatctaagtaagttatttaaagtccccaaaagcagtattgtgttggaaaagggcgaattacaacgccataagcaaatttttgtgcctgaaccgaagctcattccaaaagagattgaagtattaggctgaacactgaaaaatttctatttttccatagcaaaacagcgataaaactgctaatttacacctattgaaaaccattcttaattgagagagaaattgaaatgttatttgcggtattgaccattgtggcttatttaggtgctttattatggattatgccaacacttgctcatcttgatacggataaacaaccgaatatccgtgcagtattgcttttgggcttagttgctgtactttgccatattattagcatttctcaacatctggttgtcaatggtggacaaaattttaccattgtaaatgttgcatctctgatcagtgtgattattagtgctgtggcgactttcgctttaactcgatggaaaacggtgtggtttccattgtctgtgatttatccgcttggtattgttactgtcaccttatctacctttgtcgcaggcagttttattaaacagctgtccgaaaatctagggttaatgctccatttaggcattgccattgcttcttatgcgttattttttatcgctctactttatgcggctcaacttaaatggttagataaaaatcttaaaagtaagaaaatggcattttctcccgttgtgcctccattaatgaccgtcgaacgtcacttttttaccttaacaatggtggctcaaggattgctcacagtcgcccttgtcacaggaatgatctacttacacaacttctttgcaccagagcatattcataaggcgattttttctttcattgcgtggattgtgtataacatcttattattggggcaatggaaactccgctggcgaggaaatcgggtgctaatttattcaatttcaggtatgatactgctttcggttgcctattttggcagtcgaatggtgtaataccactaaggtagcggttagatttgttctctgtgttgcaaatttttttattcatctaaccgcttgtgactaacgaacataggacttttattttggacacgatccccctgagtagtttattcatcacactagctattcttctattgctttctgcattcttctccggctctgaaacagggctaatgtcgttaaaccgctaccgtatgcgccaccttgctgataaagggcataaaggggcaaaacttgctgaaaaactgttatcgagaacagatgttttattaagtttaattttaatctgtaataaccttgtcaatattgccgcttccgcaattgcaacaatgattggtatgcaattatccggtgaagcaggtgtggcgattgcaacgggattgcttacctttgtgatgttggttttctctgagattttacctaaaaccattgccgcactgtatcctgaaaaagttggctttactgtcagttatattcttatgccattacaaaaattattgatgccactagtgttctttatgaacctcatcattaatggcttgatgaaattattccgtatccgcaagtctgaaaaatcagggttaagtgcagaagaactacgaggtgtcgtacttgaggcagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctaccgctcaccaagagatgttggtatcaattcttgatatggaaaaagtgactgttgatgacattatggtgcctcgcaatgatattggtagcattgacattgacgatgattggaaatccattatgcgtcagctcacaggggcagcgcacgctcacgttgtgatttataaaagcgatatggataaaaacctactcggtatgttgcgtgttcgagaagcgtttcgcttaatgttagaacgtaatgaatttaccaaagagcaacttatccgtgcagtagatgaaatctactttattccagaaggaacgccattaaatacacaattgatgaatttcaaaaataacaaaaaacgtatcggtttagtggttgatgaatatggtgatattaaagggtgattacacttgaagatattttagaagaaatcgtgggggaatttactacttcaactgcaccatcattggaagaagaagtgaagccacaatcagatggctctgtactgatcgaaggctcagctaatttacgcgacttaaataaactctttgattggaatttgccattagatgaagccagaacctttaatggattaattttagagcatcttgaaaaaatccctgacgaagatacgcaatttaccttgcttaatttaaaggtcacggtacttgaagtatctgataatatggtgaagttggcgagggttgagccgatttcaaaataacacaactttcccttgaggttttatttggttaatattatgtgacaattaagttctacataatactaacaaacatagtatacaaaactattggtggatactggcttaaaacctcgtactataccgcttttaatatccaatagttatgcatttccaaacaataaagaaactcctttaaataaaactaatttaattcaagttggggatccgaatgatttttatcaaattagacaggtagagcttgcaactttaacaaaaataactacaatacgcgctcttttcaagacatcttatctaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctctattcaatcacactacctcttcctaaacattccgcccagcgcacctaaaccaccaagacctccgcccatcatacctttcattccacgcatcatttttgccataccgcctttacgcatttttttcatcatacgttgcatttcgtcaaactgtttgagcagtttattcacatcttgcacttgcgtacctgagcctaacgcaatacggcgacggcgtgaacctttgataatatctgggttggcacgctctttcagggtcattgaattgatgatcgcttccattttgatgaacattttgtcatcgacttgatttttaacgtgatctggtaagtttttcgccccaggtaatttatcaagcatcgacatcataccgcccatttttttcatttccaccagctgttcacggaaatcatcaagggtaaaatcatcgcctttcttgaattttgccgccattttttcggctttttcctgatcgacagaacgttgtaaatcctcaatcaacgacagcacatcgcccatacctaaaatgcgtgaagcgatacgatcagggtggaacggctcaagggcatcggttttctcgccaacccctaagaatttaatcggcttgcctgtaatttgacgaatagataacgccgcaccaccacgagcatcaccatcgactttggttaaaatcacccctgtaagcggcaaggcttcattaaaggcttttgccgtgtttgccgcatcttgacctgtcattgcatcgacagtaaacaaggtttcaatcgggtttaacaccgagtgaatttgctggatctcttccatcatctcgccatcaacgtgcaagcgacctgcggtatcgacaattaacacatcaaagaaattgagtttggcgtgtttcaatgctgcttcggcaatgtctaccggtttttgcgacgtttctgtcgggaagaaatcgacttttaatgcttcagccaacgtttgaagctgtttaatcgccgctggacgataaacgtcggcagagaccacaagcacttttttcttatggcgttcttttaagaatttcgccaatttaccaacagacgtggttttacccgcaccttgtaaaccagccattaaaatcaccgctggcggttgggtggcaaggttcagcccttcgtttgcttcgcccatcgctttttcaagctcagcttgcacgatttttaggaactcttgccctggtgttaagcttttattgacttcttcgccaatagcacgctctttgactttattgataaactcacgcaccacaggcaaagccacatcggcttctaacaatgccatacgcacttcacgcagggtatctttaatgttatctttggttaaacgccctttccccgtaatgttttttagggttttggatagtctgtcggataggttctcaaacatagtcttttctctatttgcaaaattttggcttaatctgaccgcttatatcccctcttccgccttcagcaccttcccccgcaagcgagggaagggaagtaagggatgaaatgttggcattatacaaaaaaagaacgaaagagggggattagatcacagaaagttatacattcatcagaaaactcaaaatctttttaaagaacttcgatgttgaattttcgtttgtaccagttcccctctttgagcttcgagaggttaggggagatttggcagaatatacaacttctctttccttgatgtaaaactgctttattctttataacaattcttctagaataagtcgatttttttacaatatgagtatgctatgtcgaaatctatttgtatcatcaccggtagcaccttaggcggtgcggagtatgtcgccgatcatctcaatgatgttctcactgaacaaggctatcaggttgggctgtttaaccaagccgaattagccgatattcaacatcaaactgccctgttagtcgtcacatcaacacacggtgcaggagaactgcctgaaaatatccaaccccttttccaacaacttgccgaaagcaatcttgatctcagccagatgaaatttggggttgtcgggttaggcagttccgattacgacactttctgcaatgctgtcaatcttgttgagcaaggcttaactgccaaaggggcgacacaagtatgcgaatctctacgcattgacgtggtgaataattttgaccacgatggaagtgcggaagaatggcttccagcttttacttcaaccttataacaaggactaaactatgaaaaagctactaggtactctctttatgttatcagtgagcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaaaagctaaagataggcataatattgcgataggttatggagcagattcaggaacacaagtaaactctcttgcgataggctaccgcactacagtaataggggctggagcaattgccttaggcaaagaagccaattcgacaaatagtcaaacaattgccatcgggagtgattcaaaagcgagcggagatgaatctattgccttaggcggacaagccaattcgacaaataatcaaacaattgccatcgggagtcagtcaaaagcgagcggagaacaatctattgtcttaggcacaggggccagtgtgacaggtactcaaacaattgtaataggtgcacgtgctagtgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagtcggacagtttacaacagcattggggagttatgcggaagcagaaacgcaagatggcgttgctctaggttatcgatccaagactagtcgtcagtcagggcgagcaggttggaaaccagataatacaaattattctattagcggaagtacattatctgctacgcatgcagcggtagcagtaggtgatggactcaccgtcactcgtcaaattaccaatgttgctgcagggacagaagatactgacgcagcaaacgtggcgcaattaaaagcactgactttaaagatcagtggcgataaaaatacgcagggtcacacaacattttatgacgaaacgctctcaattgtaggggctgatggtattagtacggcagttgagcagagaaatggcaattcaaaaattaccattactggctcaaaaacgtattttcatactaactataacgaacagtctcaaggtctgggagatcctacgactaatttcggcacaattactgacaaagctggagctacaggaacctatgcaataacagcgggggtaaatgcctctgcggctggaaattatggtattgcgatggggtataagagtaatgctagtgcttatgctgttgctcttggtagtgaatcgaaaggtgctggggcagattccattgcgataggtaattctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggttgtgggatggtacgcttaaagtgctaggcacaaatggcgaaatcaagaccaatgcgtctggctcaaccattacaatatcactagacgatacgattaaaaataaattagctgatgccagagcaggaagtttgatattcaaaggcgaaaaaacagatacaggtacaacaaatgatgctttgggtcaaaaatggaaggccaacgaagataagaccgttaccattgcaagtaacgaaacataccaaaacggtggtgttcgatacaaaggcgataacattgaaatttatcgtagaaatctagaattccatgtgttgatgaaagagacaccaacattcagcagcgttcaatatggcgataatggacctaagattaccagcaccactgacggtaatctaaaagtaacaggtacagacggcacttcctcagttaagatcaccaatttaaaagcaggtacacaaaatggcgatgcggtgaactacatgcaattttcaaatgctggttggaaacttaaaattgctccgggaacggggggtcaagcaactccacctggggcacatcttatcaaaatggacgatacggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggtccaaaaggagatgcaggagaaaaaggcgataagggtgcccgtggtgaagcaggaccaatgggccctcaaggtcctagaggtgagcaaggtctaagaggtgaacgaggcccagcgggtcctagaggcgaaactggtttaacaggtccgaggggtccagtgggaccacaaggaccgcaaggaacaccgggtactccgggacagaagggggataaaggcgatccaggacctgcgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaagtgttgataaaaagtgggctaatttgtctactatgccaaatttaaggggctgacctagattagctagcatactaatctaggtcagccccattatttaatatctatctcaattgatctctttattggtatcatcaaaatattgattcatttcaaaagcgggtttttgttgttgagaatgcccaataattcgagcagggacaccagccgcagtggcatattcaggcaccgcttgtaatacaaccgaatttgccccaatttttgagtaacgaccaatctcaatattacctaaaattttagccccagccccaatcatcacgccttcacgaattttcgggtggcgatctccgtgttctttacctgtaccacctagcgttacaccttgcaaaatagacacatcgttttcgatcaccgccgtttctcccaccacaatccccgtggcgtggtctaacataatgccacaaccaacactagccgcagggtgaatatccacatcaaaagcaacagaaatctcattttgcagataaatagccaacgcttttcgcccttgttgccacaaataatgggtaactctatagctttgcaaagcgtgatagcctttgagataaagcaaaggcgtactccatttatcgaccgcaggatctcgagtacgaacagcttcaatatcgcaggcagcactggcaataatttgcggatttgcttgataggcttcttcaatgatccctttcaatgcaatcgctggcataatcgcatttgccagtttgtttgccaaaatatagcttaacgcatcgcctaaataatgatgtttcagaatggttgcgtgaaaaaaactggcaagcatcggctcactatttgcaagctcttgtgcttcattacgaatattctgccaaataagatcaagcggttggtttgtcatctttattccccttttcgttcacgacctaaaagcgttttagcaacatcactggcgtgcttgccacagaacaacatctgataaatttgttccacaatcggcatctcaatgccttgtttttgagccagtaaataggcctctttggtattataaaacccctcaacgacctgcccaatttcagccatcgcctcttgagcatttctcccttgtccaagcattaaaccaaaacggcggttgcgagattgattgtcggtacaggttagcaccaaatcaccaagccctgccatacctataaaggtggtgggatttgcccctaaagacagccctagacgactaatctctgctaatccccgtgtaattaatgcagtgcgagcatttgccccaaagcccattccatctgaaatccctgtaccaatcgcaatcacatttttaatcgccccaccgagctgtacgccaaccatatcactattcaaataaacccgaaaggcttttgagcaatgaatacgctgttgcatttcatcggcaaactgaggatcagtggaagagagagcaatagcagtcggcaatccttgagctaactcttttgcaaaagtcggccctgaaagcaccgctagcggatagcgatcacctaaaatttgcaaagccacttcttgcaacaatcttcctgtgtctcgctctaaccctttggttgcccacataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacataatacgatgttcagaagttaataacggttgaatttgttgtagaacttcagaaaaaacgtggctaggcacaacaattaaaatatctttcgagcgagttaatgccgttgcaagatcgctttcaatctctaatgcctctggaaatggaatatcgggtagaaattcttcactcatacgccgtacagccatttgagccattttctgcgaattatgtccccaaaggtatgttttatgcccattacgagaaagtgcaatcgccagtgcagtgccgtatgaaccagcaccgagtacggtaatgggggctgaatatattttttccataaaaatatcttaattatttataatatacttattaactaatttatatatgataatctctaaaagcgatatattacagttatcaaataaatatttcacctaatgattcatggggataaaagaagtctttatgatttttaacgattttactcatttatggagtaaatttaataatgacgaagaatatcttaaggaaggtctaataatatgtaagactaactagccatgatgctaaaaatgtaataagactattcctattgaattatctctaagtttccataactattaaaatgtttatatattagacgtgtgaccgtatttttaatttttaatttttactaactaaaccaactccccacagaaccggtacccttcaccgtgaatagtcacgataatttctggggtatttgggtgatcttcaaagtgtttacggatacggcggatcgtcacatcaacggtacgatcgtgaggtttcaattcacgtcccttcatttgttttaacagatcttcacgggtctggattttccctggattttcacagaagtgaagtaaggctctaaactcactacgaggaagtttaattacctcattttcagggttaatcaaactgcgactatttacatctaaagtccagccattaaagcgataactttcggtattgtgtggatcttttaccgttttgtctttttccgccattgtgcgttgcaataagtttctggcacgaatagtgagttcacgaggattgaacggcttagtaatgtaatcatcagccccgatctctagccctaaaattttatccacttcgttatcacgtccagtcaaaaacattaatgcaatatcagtgttttctctgagttctcgagcaagcattaagccatttttgcctggtaaattgatatccataatcacaaggttaatttcgtgattatctaagatggtgttcatttcattgccgtcagtggcttcaaatacatcatagccttcagcttcaaatatgctttttaatgtacttctcgtaacagcttcatcttcaacaatgagaatttgtgggttttgcattagattaccttcagtttgtttgagttgccctgctactatgactgcgatagcgaacaaatgttgcaaagttgtagtattttatctctgttttttagcatcataaatacattattttacatttctttagcttcaatcaaaatctgctaagaaatattcgcgatgatcttaacattattgttaaagtttgacatattcaagcggtaagttaagtaagttttttaccaaactctcggtcattgctcgatggctgagtaccgcatatttttcagcaagaataacccttgaaattgtcacaccttctaaaccttgcattcgacggaaatttaaagcactttgtaacggcaagaaacttggattgaatgccgcattttctgcatagcgtcccgtgataatctgttcaccacactgtaatgccaccccactcaccgctttactataaggtgcatacgcaagatttgccgccgaaattgccgcttgttgtaacgcatcgccacttgcttcaaagctattttgttgaggatcgaataaaaccttgtcaatctgtaaatcttttggtccaaaagcatctggcaggtaactgtgtaataaattattttgactatgtggtaaatgaatttttagttgtttagcactattgagttcattcataaattggcgacagtgtccgcaaggggtgtagttcactaccatatcggttaatgcagtttcccctgcgatccaagcgtgtgaaacggcactttgctctgcgtgaacagtttgttgcatcgcatcgctctcaaattcttgatttgccccaaaatagaaattccctgatttgccaatcgccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccattaaaccgcccatcgcatcaatttctttgactaaatgtcctttgccgatcccaccaatcgctgggttacaagacatttgtcctaaggtatctacattgtgtgttaaaagtaaggtttttaaacccatacgcgcaggggctagtgctgcttcagtaccagcgtgtcctccaccaactacgatcacatcgtatatttcacgataaatcatcttatttgccttgattaaattctgtttaaatgaaaatttgtctattctacctgaaaaaagcaagatctgaaaaaaggttttgatctaaggtgaatagggtcttgataatgatcgccgatcttaataaaaaaagatctatttatataaagatctttattattgtagttattagtcttacgaagaactgtgaataactaataaatatgtaataaattcaataagatctaaagataaaacgattgtgatgatcttgaaaaagagtaagatcttagttgtggataaagtggtaagttatccacagatgatattttttgataagttattcaagaatagatctcaagataaatacaggaaaaaagagagttatccacagatgaaatgaattacttttccctttttttgaacaatatctattctatttataatgtgacacaactcacagtttttaatggattagcttctcttttagaaaaaaatccctaaaatttgtgcagttcagttgtttatggataaactttatgcaacatcgtcagcaattaattttaacttacattgaaacctaccaagaagcgagcgtacaagagcttgcagagcatctcaacgtttctttggaaactattcgccgtgatctgaataaaatggcaaaggaaggcctattatatagaactcacggtagagctgtaagccataaaaatcgagatattggacgctcttttgatgttcgtcgcagaatgaatagtgatgtgaaaaagtctattgcggaaaacgtattagagcatttttttgctggagctgtgataggtttagatgcgagttcaagtagttggaattttgcacaactcttacctgatctaccttgtacggtcgttaccagttctatgcataatattcgagcattagcaaataaaaccagtattgagatcattgcaacaggtggtgtgtactcagcaaaatatgatgcattttatggatctctttcggagcatctactttctcgtttaaatatagatattgccatttgttcttgcaccggtattgcagacggtattgtgtgggaatctaatgaaatgaatgcaatagctaaacgaaaaatgctagcagcgagtaagaaagtatttttattagcggatcattcaaagtttgaacgtaaagatcttattcagctttgtgatctttctacaattcaccatttatttacgaatcgttgccctcctgattctattcagatgctttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcaacatcaaattaatataactatttaaagtaaaataataatgtaatgctcaaattttgccctgcttctttattccgctaatcataaatctgggtttagaaacaaggcaattttgttttaagtctgctatttacttacttgagtcttgttgtaatcaggatgttttggtccaataagcaaaccaccgtttttccctaagtgaacaagatttgatgttgcaggtgctgctatttgataccctttatctttactggtatccattatttgactcacagctgctttaactagcatcactagcagaccatcattactatttgatgatccctgtgcgaaagaaccagccccttcccataaggtttttcctgttttgagatcaactagttttccttctaaggatacgttagttacgctatcaattaatttatagctcgtaccatattcctcaacattcacatagaagatcgcatctgcaccaaaaatttcacggattttgtttgtttttgctgagcggattgcatttccatcagttaaaccattctgtttgaatatttcatcaactaatgcgactggaaaaacatagtaacctagttcacctaaaggatagcttgttctagcaagaacactcgtatccgcctttgcatctacagagctatttgttggcatcactaccaaaattgattttggtttgctattttttaactcagtataatcataagaatccactttttgtttagcacagccagctaataatattaaacttgttaataaaacaaacaattttttcatagatgatccctattttttacgttgtaggtattgcataagcgttgtactttcaggatgtaattcctgctcttttttcatagctgtttgagcttcagcttgttttccctgttttaataaaacaagagctaaatgcccatatacaccgggtgcaacagttttttgatgtttagctgcttcagcaataatttgatttaaactttcttcttgcttaccaaaatcaccaggttcattataataatgatatataacatcagaataatttccccaatagtaaatatctttatttacattattagaagaacaagcagataaaatgatagagctaacaaggaaaatagtatattttatttttttcatattgattccttagtgagatggctgccaagagccagattcgataccatttacaaggttatttacagcttcacgaattgcaagatcaagaacttttccatttagtgttgcatcatagcttgcagttccaccaaaacctagcacttcacggtttgataaattatattcaccagcaccttgtgaggagtaaacaacttccgatgtttctacgttaacgacgtttaaggttacttttgcataggctacttgttcttttcctctacctagaattccaaatagttgatgatcgcctacggttttacgtccaaattctgtaacatcgccagtaatcacataggttgcaccttttagattttgttttttacctttgatttttgcttcagaagcaatttcactcatatttgtacgatcaaccacagaaaaacgaccagtttgttgcaaatgagagattaaaattgtttttgattggttacctaattgatcaggaccatcagagaaaactccgttttggaaacttgatttgttatcaaattttcctactgaaataactgattttacgcctttatattgacttgcagttgtcgctgcctgagttgatgttggtgtaattacttttgaattttcagtagcacatccgactaatgttaatacagtaaggcataaagctcctactttcaaattactcataaaaaactcctgttaagatgaaaataaaacctatcaaatagatttatcaatatttgataccaatttcggtttaaaacgaaattagtacgcatattattatatttattttatgttgaaaagatgcccgattttcccctttctatcgccaaatcgggcaagtaaattgtaaaaaaattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtaaattgtaaaaaaattactcaatcttaccgcttagggctggctttttgtgaggcaattcacaaaatctgcacaaatttcgtaaaaattcttttttcatcgtcaataagtagcaaaatatcctcgtcagtttaaccagttaattaaggggatttttatgactcaactcaaatcaactccagtaaaaattggtatccgcccaaccattgatggtcgtcgtcttggggtgcgtgaatcattagaagatcaaacaatgaatatggcgaaagcggtggcgaagctcattagccaagaagttcgccatacaaatggggattttgtcgaatgtgtgattgccgatacttgtataggtggtgtatttgaagcagctgcttgtgccgaaaaatttaaacgtgaaaatgttggtgcagtgattactgtgacaccttgctggtgctatggctctgaaaccattgatatggattcgcatatgccaaaagcgatttggggctttaatggaactgaacgtccgggggcagtttatttagcggcatctctagctgggcataaccaaatgggcttgcctgcgttctctatttatggcaccgaagtgcaagaggcgagcgatcaatctatccctgatgatgtgcgtgaaaaattacttcgctttgctcgtgcaggcttagcggtggcgaccttacgcggtaaatcttatctctctatcggttctgtatcgatggggattgcaggctctatcgttaatcaagagtttttccaagactacttgggtatgcgtaacgaatatgttgatatgtctgaactcactcgccgtatggaacgtggtatttacgacaaagaagagtatgagttggcattgaaatgggcaaatgaattctgtattgaaggtgtggatgtcaatgcgcctgaaaaccaaatgagtgcggaagagaaagctaaattgcgtgaaaccttggtgaaaatgaccattatcacccgtgatttaatggtgggcaatccaaaactggctgaactcaattttggtgaagaagccttaggtcataatgcgattgccgctggtttccaaggacaacgccattggacagaccacagcccgaacggcgactttatggaagccttactcaactctacttatgactggaacggcgtgcgtcctccatatattcttgcgaccgaaaacgactcgctcaatgcagttaatatgttgttcggtaacctcttaaccggtcaagctcaaatctttgccgatgtgcgtacttactggagccaagactccgtagagcgtgtaacaagctggcgaccagagagtggctttatccacttaatcaactcaggttcagccgcattagacggtacaggacaacataccgataaagatggcaaacctgtgattaaaccgtactgggaagtgacagaagaagatggtaaacgttgcttagaaaatacccgttggtgtccagctgtttatgaatacttccgtggcggcggtttatcttcacaatatctcaccaaaggtggtatgccatttacgatgcaccgcatcaatctagtgaaaggtgtcggccctgtactacaaattgcggaaggctggtctatcgacttacctgaacacgtccacgacattctcaacaaacggacaaatgaaacttggccaaccacttggtttgtaccacgcttgacaggacaaggtgcgtttaccgatgtttactctgtaatggcaaactggggagcgaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggagcgaaccactgtgtagccacttacggacacgttggtgcggacttaattacccttgcttcaatgttgcgtattccagtcaatatgcacaacgtggcagataaagatgtgttccgcccaagtgcgtggagtatgttcggacaagataaagaaggtcaagattaccgtgcttgtgcgaattttggaccgctttatcgttaattaaaccttttctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctctatgccaatcgcatttatcttcgattgcggtgcaaccaatttacgcatagtggcaatggatcatcacggcaaattactggcggtacatcacattgcaaacaatacccaacaaggtgaagaagcaaccgactatcacatttgggatattgatgagatctggtcaaaactgatgacctgtgccaaacaaacccttgcacaacttacccctgaacaacggcaagatattgtcgggatttcggttacgacctttggggtggacggggcgatttttgacaaacacggcaaacaactctacccgattatttcgtggaaatgcccacgcactcagccgattatgcaagcgctcggcgattatctcgatgtggaaaaactctaccaacgcaacggcgtggggcattacagcttcaacacgttattcaaattgctttggttgaaacaacataaacccgaactttacgcacaagcggagagtttcttgtttatttcttccattcttacttatcgtttaacgggtgtacaaagcaccgacagaacaatggctggtacatcaatgatgaccaacattgcaagcgactcgtgggatagcgaagtgctagatgtgttgggattaacagcaaaccattttccaccgatgaaaagtgcaggggaaaaaatcggtacattactgcctacacttgctgaagagcttggtttatcggcggatatttctgttctctcttgcggacacgatacccagtttgcgatcttcggctcaggggctggctacaaccaaccggtattaagttctggcacttgggaaatcttaatggctcgcacccaacaagccaaacccgaatggcaatatgtcaaagatggcttaaccattgaatttgacagccaagcaggctatttcaacccaggcgtgcaatgggtcagctcaggtattatggagtggctcggtaaacgcttctttagcgatgttgcaggtacagccgactattatccaacgatgattaacgaaggatcacaagttccagcaggttcgaatggcctaaaactggtctgtaattttgacggtaccagccaacaaactggctcaatcgaagggctttcaacgaagtgagttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactggctcaatcgaagggctttcaatgcacacccaacgaggcgaaatttatcgtgcaggtttggaatatatggctcaccgcttgaaagccggacttgaggtattgcaacaagtcggacagttcaatgcagaaagtattatctgtgttggtggcggttcaaaaaatggcttatggaaccaaatccgtgctgatgtgcttaaccgcccaattgatgtcgtcgatatgtccgaaaccaccgtgttaggcgctgcgatgttcacgctcacaggtgcaggcgtattcgagaatatcgaacaagctcaacaggcaatgaaaccagcgcttaaacggatggagccgagtggagatgtgagggtttatcaatcataggagcgtaaattttccccaatatagctcccctctttagcaaagaggggctgggggagatttgacaggagtaattaacgaagaaaataatttatttggtaacgagtagtaaaatattaaggactttttaatctctcactttgcttattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatatatgttaaaaggcattcaccctgcactttcccctgaattgctgaaagtgcttgcagagatgggacacggcgatgagatcgtcttatcagatgcccattttcctgcacatcaattacatcataaagtgatccgtgcagatggtattcaaattgccaccttacttgaagcgatcaccccattatttgaatatgaccaatatgtcgaacgtccactggcaatgatgcaagcggtacatggcgacagccttgatcttgcggttgaagaacgctatctcgccgcaatcgcaaaaattaacggaaaagcaccgcttgttgaacgtgttgaacgcttcgccttttacgaccgagcaaaaatcgcttatgccgtagtgattacaggcgaattagccaaatacggtaacatcatcttgaaaaaaggcgttaccccagttttaacagattaggaggagagtatgaatcgtcaaacattagagagaaaaattattgacacctgtttggaaatgacccgtttgggtttaaaccaaggcacggcaggaaacatcagtgtccgttatcaagacggtatgctgatcaccccatcaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcctttctgatgaagagatcaaagtcgttttaggaaaattttccacttatggattgagagtggaagagaaacattaatttaatgttatgttagaagggcgagtagttaaattactcgcccttttactatgaagcttttcttaaggctaatgaaacagctatagtttgagctaatgtcattgtggcacattgtgaacggaagccgctaatttgagcttctttaataataaaagaaacatcactgaatgtaagcagtgggctaagttggctagggtgaaaaactgattgcaataacgacatcaccttctctaatcctatttagttgttcactaaacataccacctaaaccatcaattaaaaatacgtcgtaattcaaatggcttaaggcataatttagataacttgcgatactaaaagatcgttttaaaccaacaataaaaatacggtttgcattatctagaatttttgtaacggcttctaattgttcttcggtaatttgattggctagttgagcgagagcttgattattcccttggataaataaccgcagaatatcactgtgatcgcctttagattcatttaatttaggttctatttgacgaaaaagttgaactcgctcagtataacttgttgttccttccatcaaattttgtcgatagagttgttttatatcgttaaatccacttaagccaaaagcattcgcaaaacggattagggtcgaaggcggtacttgtgctttttcagcaatttcagaaacggtgtcaaaaattacactatctccattgtctaaaatatattgtgcaacttgtttgagtcttttgcttaacgagtcatattgtttacgaacttcattttgaaaatgggttaactgggtttcttcattcatttcattcagattattattatcaaattaagcacaattatactgtattttgttgctttttaaatcaacccccctaatatttatcatattaggggggttatgtttatttagtatgcaaaattagcgttgcttccaataacgaatgagtgtttgataacgtaacgcaactgcatcaattaactcttgatcattcagctgatttgctaaccatttttctgatgcctcaccaaaaatggtgcgacctacggcaaatcctttcacttttgagtaatctttagatgctttgaagaccgcttcaaatacttctgttggtgcatccagcccgagaattaagataccacggcaatctggatcgtatttatctattgtttcactcaatttagcccagccttctgcagaaatacctggtaatttccaccattctggttttatccccaattgatagaagtgttctaccatttcattatagtgattttcatcttgatccatggttgctggtagaataatttctaacaacaattcatgcccagtacggcaacaggcctgatacacttcttttaatttacgatcttggcgttgacgaagttcttgattgtcttgtggatggtaaaatgctaaacatttaatcacatgatctcgtgggaatgtaactaattggctacctaaatcaccgtgctcaagttctaatggacgagaacttggttcttcaattggacgagcaatccaataattttttcccgtaatttcattaagagcatcttgaccaaatgtcgtatccgcaagaatacctgcatttccatgagttaaaccttccgcttgtgcggtttgttccatcgctttaagcagtaactgttttaattttggaatacgattaacatcagcacccacttttgctgccatatccactaattgtttacgatgatcaaaagcaaaaatacagagatcatcccactgttttttgcgtgtcgttactcgatgtaagtgatttaatttttcatctaaatcaggacgaggtacacttgctgcacggctgagatagtcatctaattctcgttttgtcggcattgcaggtgcacagccgtgacgggaaacaactaaagcaccacaagcattagcataacgacaggcttgttcccacccttcattatttgcataacctctgagtaaaccagacataaaggcatcgccagcaccaagcacattcagtacttctacccgtacaccatacacatttaatccgccatcaatatgatttggaatatcaccttcaaatacagagcaacctaatgcaccacgtttgcaaactaatacagcttgggtaaattggcgtacatttttcaatgcggttaaggtatctgttgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagcacttcttgaagggatttagtcacttcctgagaatcaatatagcgagtttcgccatcacctaaagaggttaaaccccataataccgggcggtaatcaatatctaatgcacgttttacgtcattatgacctgcatattctaaggctgttaaaacggtttctcgtgttttagggtgagaaagatgagtacctgtaatcgctaaaatacgtgacgaagcaatgtaactttcactgaaatcatccttactaatcgccatatcggcacaattctcacgatagaaaatcagcgggaaggtttccttatctttgataccaagaataacgagcccagttaaacgctctttatcggtaattaaatggctagtatcaacacctacgcttttgagctcttcacgtaaaaaacgccccatatgttcgtcgccgacgcgagctaacatagaagaacgtaatccttgaatagcggtgccatacgccacattcccagatgagccacccaaatattttgcgaagctcatttcctcttcaagccgagaaccaatttgttgaccatataaatctaccgcaactcgcccaagacagatgacatcaagagggcgatcttgatgattaacgtatgccataacaatgcctccataaaataattgaaaagatcttggttttcaatcatcatacaaaaatgaaataaatatttcaaattaaacttaattttttatttgtttttgtgaccaacatcaaatctttaactattagggaatcaagtttaaaaaatgcgagatagatcacatcattaactaaaatgctttgatattataaaatgaaataaatttttcataatgtgaaaaactgctttaattttatctctaacctaggagggagtatgcagactatcaaactcacagtggcacaggcacttgtgaaattccttgataatcaatatattgaaattgatggtaaagaaattaagtttgttcacgggatcgctgctatttttggtcacggtaacgtattgggtatagggcaggcgttagaacaagatgcaggctcattacgtctttatcaggggcgtaacgaacaaggaatggcacatcttgcaataggttttgcaaaacaaaataaacgtcagaaaatcattgcttgcacttcttcagtcggtccaggtgctgccaatatggttacagcagcagccactgccacagctaatcgtattcctcttttattattaccaggtgatgtatttgcaacgcgacaacctgatcctgtattacaacaaattgaacaaccgcacgatttaagtattagtactaatgatgctttccgtgcagtgagcaagtattgggatagagtacaacgacctgagcaactaatgagtgcttgtatcaatgcaatgcgggtgttaactgatcctgctgaaacaggggcagtgacaatagccttaccacaggatgtccaagcagaagcctatgacttccctgtaagcttcttacaaaaacgagtacatcgcattgaacgtacgccgccaacacaagaaatgttggcagatgcagttaaattaattacctctaagaaaaaaccacttattatctgtggtgggggcgttcgttattctcaagcgtgtcgatcattacaacattttgcagaaaaatttggtattccatttgcagaaacacaagcaggtaaaagtgcaattgtttcaagccatgaattaaacgtaggtggtgttggtgaaactggctgcttagccgctaaccgcttagccaaagaggcagatttaattatagggattggtacacgttataccgattttacgacatcttcaaaatggattttccaaaatccagaagtttctttcttaaatgttaacattgctcgcttcgacgcatataaattagatggcgtacaaatggtatcggatgctaaacaaactattaatgcactcattgataagctaccgctgggttacaaaacacaatggggagataccattaaacaagcaaaagcggactttgccgatgaattacaacgcttacgacaagtaaaatttgctgacggatttgttccagaaattaatgataatcttgatcatgatgccgtttatgctgaatttatcaaactcaccaactcttgcctaacccaaagccaagttttaggtattgtaaatgaaacgattgataatagtgcagttatcgtaggtgcagcaggtagtttgccaggtgatttacaacgtacttggttaagtaagagtgaagacagctatcatcttgaatacggctattcttgtatgggatatgaagtcaatgcggctgttggtgtgaaaattgcacaaccagaacgtgaagtttatgcattagtgggcgatggtgcgtttttaatgtcccactcagaacttgtcacttcaattcaggaaggtaaaaaaatcaatgtcgtattgtttgacaatatggcaaatggttgtatcaacaatttacaaattggtaatggtatgggtagctacggtacagaattccgtttccgtaaccctgaaacaaaccaacttaatggcagcttaattccagtggactttgcaatgtgtgctgcagcttatgggtgcaaaacctacaaagttacaaccgaagatgaattacgcaaagccttagctgatgcaaaacaacaaaccgtatctacgttaattgatattaaagtattaccaaaaacaatggctcatggctatggttgttggtggcacgttggtgttgctgatgtttcaacgagtgaacgtattcagcaagcacatcaacgttctaaagaacagttagcaaaagcaagaaaatattaattacaagcggtacgatttgtaaaattttttgcaaatcataccgcttacactctttctatttatttctcaatgaggatttcactatgaaagctgaaaacattcaattaggtattgcccctattggttggacaaacgatgatttaccggaacttggtgcggaaaacacatttgaacaatgtgtgagtgaaatggcacttgcaggctacacaggctgcgaagtaggtaacaaatatccacgtgatgttgctgtccttaaacataaattagatgtccgtggtattcaaatttgtaatgcatggttcagcacattctttgttgatggcaaacgagaagaaaccattcaagaatttatcaaacaccgtgattttctacacgctatgggtgcaaaagtgattggttgctcagagcaaagccgtagtattcaaggtacaacaaaagcagtatttaaagaaaaaccaattttcaatgatgaagactggcaacgtttagctgagggttataatgaattagccaaactcgctgctgaaaaaggaatgaaagtcagcctacatcaccatatgggaacaggcattcaaactccagaggaagtcgatcgctatatgtctgtcgtcaatgatgatgtttacttattatttgattctggccacctttactattcagaaggctgccaaaaagcgatgttagctgtacttgaaaaatatattcaccgtatcgtacacgttcacttaaaagacgtacgtgatgaagttgttgcagaagtcaaagccaaagatttaagtttcttagaaggtgtgaaaaaaggtacatttaccgttccgggtgatggtgtaatcgatttcaaaccaattttcgatattcttgaaaaatacgactacaaaggttggatggttgtagaagcagaacaggatccagcattagctaacccatttgagtatgctttaaaaggtcgcaaatatattcgtgaagtcgcaggagtttaatatgttaaaagttggtattattggtgcaggtcgtatcggtcgtgtacattcagaaagtatctcaaaatatgtaaaaggtgctgaaattaaagcgatttcagatattaaggtcactaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaattaaccgcttgggcaaaatcaatgggcattccgaatgtctatgatgattacaaaaaaatcctacaagatcctgaaattgatgctgtattggtttgttcgtcaaccaatacccatgcaccaatttcaatcgaagctgcacaagcaggtaaacacattttctgtgaaaaaccaattgatgcagatgtgggacgtattcacgaagtattaagtgctgttgaaaaagcaggtgtaaaattccaagtaggttttaaccgtcgttttgaccataacttcaaagcaattaaaaaccgtgttgcgaacggtgatattggtgaaccacacctcattcgagtcacttctcgtgacccagatgcaccaccaattgaatatgtaaaagtatcaggcggaatgttctttgatatgactattcacgattttgatatggtgcgttacttatcaggtagtgaagtggttgaagtgtttgcggctggcggtgtattagttaatccagaaattggtaaagctggtgatattgatactgcagtgatcaccttaaaactagcaaatggtgcaattgcagtcattgataacagccgtaaagcggtatatggttacgaccaacgtgcagaagtctttggttctaaaggtgcggtacaaactcgtaacgatacggattcaaccgctgtatattcttgtgaagctggcgttatcgcagaaaaaccaaaatatttcttcttagagcgttatatgcaatctttcgcagatgaaatggcatgtttcattgattctgtggtaaacaataaaccaacactcgtcaacggtaacgatggtttacaacctgtcttaattgcgttggcagcgaaaaaatctcttgaagaaaatcgtccagttaaattaagcgaagtcgcttaattctcccgatacaagcggtacgatttggtaaattttttgcaaaatcgtaccgctttcatttttattgattaaggtaaattcaaaatatcaaatcagtattggggacataaaaaaaacctagccacttggctaggtcttgttatttatagcttagattatttagcttcagctcttgctctttctgccattaatcgttcttgttctaataactcagcatcttggttttgttctttcgctacacagattttttcatacattttgaagaatggatagtaaatgaaaatatcgagtatgattaaactcaagcttaagataggagcccaaacatcaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgataccaaataagctccgataggtgcaggggttgtccaaggtgccattaagtagatgcggtggatgagatcaaagtctaagatgagataagcgatgatcgcatttgccattggtgcaaagattaatgggataaagaatagtgggttaaccaccattggaacaccatacacaatcggttcaccaattgagaagatagacggaaccaaaccgattttaccaattgagcgtaaatgtgcagagcggctgcgtacgagtaggattgctaatgcaataacaccaccagatgcaccatgtacaatgtagaagtcccaaaatgagttagtaataatgaatggaagtggttctcctgcctgtaatgccgctaagtttgccgccatattttgtaataggaatggtgtccaaagttgcattaatacaagtgatccgttaatacctaggaaccataataagtgcgttgcaaatacgaataaacagattgcaccaagagagtcactcactttaattaatggagccataaagtccataattaattgtggaatatttgttcctgtggcgtgttctacataaagggcaaatgggtagagtgtcactaatacagctagaattgggataacaatattgagagattcggcaactgctgttggaacttcttttggtaagcggatgcgaatatgcaaatactcaagtaagcgtgttaactctacggtataaattgcaatgaagatagaggagaacagtccaataccaccaaaaaatttaatgtccatcataccatctttaactggtgcagcgaccaataagaaagccatgaccgacaataaagctgcaggcagtggctcacgtttataagctttagccaagttgtatgcaatacttcctgcggtaaataatgaaatggcattaaatgacatttggaagaaacgccagccatagtcgcttgcccaacgagcaaactcccaccacgctttaccaaatgcattttgcgtattctcatcaaaaggtggaataagcaaaatcataataaaactaccgacaatcaaaaatggtaatacaacaataaaaccatcacgaattgcagaaatatgtggttgattttccatccgttttgcaactggtgcaacgtggttgttcataaaatcaataaaacgtcctgatgtggttgacatactatgcttctccatttgcaattttgaaacctaacatataccaatcttcttgatagttttcgatatgtaatgttctgcctttttcgttgtgctcaacgttaaacttaacagctttatttagtgattcaagctcaccaaacactgaaagcggtaagttattttgtccgttttgtaatccatcaataaagagatagagatcagtgcctacttttgtgtaataggtagtgagattaccaattttttgcgttgggaatttgctgcatcttgaatggtagataccttcaccgttgatatttagccattgtcccagagcaagtaaacgctccacttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcttcaggaattgttccatccgcttttggaccaatattgagcaataagttaccgttatcagcgacagtttcaaccaaaagagaaacgagatctttaacagaaatcaggtgactttcatcttcaatttggttgtagccaaatgaaagccccataccacgacacatttcccattttttatcacgagaggctgttccgtgtttatactctttagacgtaaagtcgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagtttattccaacgatcatcaacaacgccatctgcaacagaattgtagtagtgagcaaaaaggtgtggaagcatatgttccccaacttttggccaaccaatatcgttccatagaacatctggtttatagcggtcaatcaattcaatgacttgtttataagcaaagtcggcatattcgtaggttgggcaggcattagagaaattttggctttctgtaaaaataggtgctgaagaatattgccagtcgataataccagaatagtatgcccccatacgtaatcctttttctcgaacttgttcagtgagttcacccattaaatcacgttgaggacctgctttggtgcagttgaaatcggtatatttacttggatataaacagaagccatcgtggtgttttgtcgttaacacgacgtatttagccccagcttgagcaaagagttctgcccatttttcaggttgccatttttctgctttccattgcggaataaattggtcgtaagtgaaatctttgccataggttttaatgtgatgttcgtaagttggtcctttctgaacgttaatggaattaaaataccattctgcgtacggattattacagaaccactgctcatcaatatcaatttcacctaattggcaagttggtggagcgaatgcaggaacagaataaactccccagtggataaaaataccaaatttagcatcttcataccattgaggtacctcatgggttttgattgactgccagtctgcgtggtaacgtttttgtttagtgtcagtcatagtaggctcctatttttagcatacataaaaataaggtccgcatatattgtgatatgcagacccttccgatttcatattaaatttctttcacatctacccagcgtttttcttcagcggatttagcgatggtttcgagaactctggatactctatatccttcttcaaaatctggccacattctgtcatctgcggcgataccattgactaaatcacggatttctacgcttttttgatcattaaaaccaataccgtgtcctgcacttacgcagaatgcggcgtagtcaggatgttctggtccaacgagaatagttttaaatccttgacgagatttatcttcatcatgtaaataaagtttaagttcagccattctctcttgggtgtaggtcaatgtgccttttgttcctgttaccacgtaggtcaagcccattttacgaccgcaagcgatacgagagctttcaatcgttcccatcacaccattggcaaaacgcaccatagcggttgcttggtcttcgttttctactttcactttttctgaaaggttatttggatttgggcgttctgtgataacggtttgcatatcgcccacaaccgaggtaatttcttcaccgactaaataatgagccatattaacaatgtgagctgcgagatcgcctaacgtacctaatcctgctttacttcgatagcagtgccagtcaatcggtgtatttgggctagcaagatagtcttcattatgtgtgccataaaaatgcaccacatcaccaatttcgccatttttgataatttcacgagcaagctgtgatgttgggtttttcatataattgaaaccaacgagcgtttttacgcccgcttttttagctgcttcaaccatctcttttgcatctgctgctgttaatgctagcggtttttctgaataaacatgtttgccattagcaatggcaaccaaagcgatttctttatgtaagaaatttggtgtacaaatatctacaacatcaacattcggatctgcaaccagttctctccaatctcctgttgctcgagcaaagccaaattctttcgcttttttctctgcaagttcttgattaatttcggcaagatactcaaggtgtagttctccttttaatgggaatagtgttggtgcttgtgcataagcaatcgcgtgacaacgaccgatatagcccgtacctactaaaccaattctcacttttttcatacaaagctccttaagttgtaagcggtatgatatacagaaaatgttgcaaacttttagagatatcttgccgcttgtaatctgtatgtttatgcgactatgcggcttttctgcggcgttttaatgtatcgagcaatacggcaatcacgataattccacctttcacaatttgttgccaataagggtcaacgcctaacatatttaatcctttattggttgtaccgataattaaagctccgataacacacattggaatggttccaaagccaccgcttaacgaaacaccaccaattactgccgcagcgatagcatcaagttcccacgctaagccataagatgggttacctgcataggtacgagctgcaagtaatgcaccagcaagaccagataaagcccccgcaaaggtataaacaagaattaatgtttttgttgtattgattccacagatttttgctgcgttgagattaccacccacagcataaacgtgacggccaaaggttgagcggcttagtaaaatatgtgagccaataacaatgagaatatagagaataactaatccaggtaagcccagaatgtttacatcggcaatccaagtaaaggcttcagatgaagcatcgatagggcgtccagcagaataaagctgtgcagcaccacgtgcaataatcatcatacctaaggttgcaatgaaaggcggaataccaccgagagcagttaacccaccatttattgcacctaaaaaagcacctagagcaagggacattgcaaaggctaaaatggcagaactagctaaatctccccctgttaccattgaggctgcaactacggaggttagtgcgacaacagatccagaggataagtcgatccctgtggtgataatggcaaacgttaccccaatagcaataataccgaacattgatacttgctcaataatactccacacggtacgggcagagaaaaagccttcgatagaaacggataataggagaaataaaataattaaaattaacaccattccatatgtattaattattttctttaatgttgcttgtgacatagtacatacctcgctatttataaataatatggtttgagtctttactgttttactaatccagatgcaaatgctaggactcgttcctgagagagttcttgatgtggaataatgccaaccttatgaccttcgtgcataaccattacgcgatcgctcatcgataatagttctagcatatccgaagtaatcataatgatggttttaccttgttttgagagttctaccattaacttataaagttctgctttagctccaacatcaatcccttttgttggctcatctaaaattaaaatctctggttcaagtaataaccaacgagcaagtagcactttttgttgattgcctccagataagttatttgtaataacctctacatcaggtgccttaattttgagtttctttttctgctcattggcagtttgttgtgatttatcggtagaaattaagaaatgttctaaataaggcgacatttgtggcatgatcatattgtccacaatgtttaaattgaggaataaacccgttaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggaataaacccgttaatttacgatcttcggtaacaaagccaattttatgtgccatggcatcaagaggatttttgatttcaacttgtttgccatgaatataaatttctccactatctgcaggtttataaccaaataaactttcaacaatttcagagcgaccagctcccactaagccagcaattccaaaaatttctcccttacgcacagaaaaactgacatcttgatattttcctgctcgcgtaaaattcttaacttcaagaacaatttcattagataattcaaaacgttctctttggaacatctctgacatatcacgtccaaccatcattgaaattaattcttctttagttacatcagtagtggcttttgtacctacatattgtccatctcgaataacggtaatttcatcagatactttgaaaacttcatcaagtttatgagagataaagataatggcgataccacgttttttaaccgcatcaatgattttatatagttgttctacttccatttcggttaaagcggttgttggttcgtccataatgatgattttggcatcattagaaaccgcagtagcaatagcaactaattgagcttttgcaactgaaacttcggacattttgacggtaacgtccattggaataccaagctcagagagaatttctgctgctttgcgatccatctctttttgatttaataagaattttccttgagtaatttctcttcccaaatagaagttatcagcaatagttaaatttgcagcgggagagatttcttggggaaccattgtgagtccactacgaatagcatcaatagggcgagatggtttgaacggtttatcatctaaaattaattcactaccgtcatcaggaatatagataccatacaggattttcatcaaggtagatttacctgctccattttcccccattaatgcgtgaattgtgccacgttttacttttaagttgataccgtccaacgcttttaccccggggaacgttttagatacatttcgcatctctaaaatgtaaggggagctagttgtattcatttttgactccttggtttttaaggatgatttatcgttttgtcctcatagattgagaataaaagagataacttattaaagggtgaattcaccctttaataagtttatggttaattatttatattttgctctgtatttctctttcatatctggagtcactaattcaaaaggaacccagttgtatttttcaacagcttctccttttgcgattttataagcaatttctgctccagcgtatccttgtccttgagctgattggaatactgttgcgtctaagccactgcctaagtattcaagagcatctggtgttgcatcaacacctacaataatgatgtcttcatctttaatacctaacttgcggcttgcaagtactgcaccaatcgccatctcatcattgttacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcgccatctcatcattgttacttgcaataacattgatttttttgttagcaacaagcacattttctgcaatggtgagacctctatctctttcccatttaccttcttgttcagaaactactttaacgttacctgttctagcaaagacttctttcactccttctgagcgtttggctgttgcatctaaaccaagaatacccattaagattaaagattctgcagatttaccatttaaagcatttacaatgtaatcaccttgaatacgtccagcttcaatttcatcagaaccaacatagctagtaacatattgcatatcttcatcgtttggtttacggttaacaacaattaacgggatattcgctttcttcgctaatctcccaattctcttcacaatttgtggatctgttggaacaactaataatgcatcaactttttgatcgataaagttttcaacatcatttaattgacgtgcagggtcaccatttgcatcagtgagtttaatttcaacgtcattatgttttgcatcaaaatctcttacagactcttgtaaataggtttgccatttatctgcaaatgcagccattggtgcaccaataacaatatttttggcagatgctgtttgagatagtaatagaccaccacataacatggctaataacgcttttttcataagctactccttgatgttgagctaaaatgatatgtctgaaatatcactcatatttcacaattagacaaaataaattgagaatataaatttcaaaattgaatgattttagaataaatcatccgtatatatgtatatcatttcatgtgaaggttcgcaacgacgaagttataaatttgtgaattagatcttgtttttctgtaattattactactttctttctctggttatcattttttaagggttgccaagagaaaaaagtgaataaaaaaccccacatttctgtgaggttttttacaattaaaatgagtagattattacaatgttggcatactgaatgcagcttgtgatctcacgctattatctggccaacgtgttgtaatggttttcatacgagtatagaaacgaacgccatcgctaccatacacatttaatggaccaaagatagaagctttccaaccaccgaaacagtggaatgccatcggtactggaattggaatatttacgccaaccatacccgcttgtacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatatttacaaccatacccgcttgtacatcttgggtaaattgacgagctgcatctccatcacttgtaaagatagcactaccgttaccataaatgtgcccattaataatagacataccgtgagcataatctttcgcacgtacaacgcaaagaactggaccaaagatttcttctttataaatagtcatatcggttgaaacgttgtcgaataaggttcctcccacaaagtagccattttcatggcctgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttatacggacgaccatcaacgcaaagtttcgctccttgttctacgccttgatcaatatagctgatgatttttgctctatgttcttttgaaataacaggccccatatcattttcttgttgaccttctggtaaaattcctggtccaatttttaatgcttgtacttttggtaccaaggcttcaacaagtttatctgctgcttcatctcccacaacaacagcaacagaaagtgccatacaacgttcacctgccgcaccaaatgctgcaccaagtaaggtatttgctgtactttgaatatcggcgtcaggcataattaatgcatgatttttggctccaccaagagcttgtacacgtttaccatgagctgaacctttttcataaatatattgtgcaataggggttgaacctacaaaactgaccgtttgaatacgaggatcagttaataaaatatcgacagcctctttatcgccctgaacaacattgaataccccatcaggcaaaccagcttcttttaaaagttcagctaaacgaatagatacagatggatctttttcagatggttttaatacaaaagtgttaccacaagctaaagcaatagggaacatccacatcggcaccattgctgggaagttaaatggtgtaataccagctacaacacctaatggctgctgcattgagtgaatatcaatacctcgtccagcatttgctgagaattcccctttttgtaagtgagggatacctgttgcaaactcaacaacttctaaaccacgagttaattcccctattgcatcagagtaaattttgccatgttccgttgtaattagacgagctaattcatcaaagtttgcttcaagtaactctttgaatttaaataaaattcttgcacgtcttaacggggactgttgcgaccagttaggaaatgctttatctgcagcttcaatagcttgattgacttctgctactgtactaagcttaacttttttgatttcttcccctgtagctgggttaaatacagacgaaaaacgagagctggcactctctacttttgtaccattaatgaaattctgaacaaattggctcatgtgtgtgctcctatgaaatataaagtagaaggaattctagacaataacggtgcaaagctacctctaaaaaaagaaaatttcaagctaaaaatcattaaaatgaaaaatatatttcatttttgtgatcagtatagaaaaatgagcattttctaatacaaaaaagtgtagatattttttatagtacaggcttaggtcaataatatttaatgtgaggtatttatgagctatttactgtcaaaaagtcaaaaacacggacaaatccagcacattacaccagaaaacgcaaattgggagtatgtaggttttgatgcttaccttttgagtaaaggagaagaaattacattagagagtgggacaagtgaactctgtctagtgtttgttgcagggaaaggcaatgtaatcaccccaacagaagtttttgaaaatattgggaataggtctacaccttttgaaaagattcctccttatgctttatatgttcctcatcattaccaactaaaagttgttgctacggaagatttagaactggctgtttgtcgagcgcctagtaatggtgatttaccattacgtttaattacaccacaagagataggtgtagaaaaacgtggagtcggtaataaccaaagattagtacataatattttacctgaaacagagcctgctgatagcttattagttgtggaagtctttactgatgaaggcaatacgagttcttatccaagccacaagcacgaccaaaaagattctccaaatgaaacttatcttgaggaaacttattatcaccgtttcgagcctgcacaaggttttgcaatgcaacgagtttatactgatgatagaagcttagatgaatgtatggcggtttatgataaagatgttgtgaaagtaccaagaggctatcatccagtagcgactattgctggctataataattactatttaaatgtgatggctggtcctgtacgtaaatggcaatttacgtgggaaagcgatcatgcttgggtaaacagtatggcttatagtgagaaattcaaatagatactctactgaaacatataatatctttccgtttaacctgcccgattttcctacatttttcaaaaaatcgggcaggttctttttgtgaaaaaaataatcaataaatgattttttttgtgatacctttcacaaaattaacatctcaatgtaaatccactttgaaaactgtcaactttgtacaaatatgctttccgttacctaggtaaaccatttttattattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcctttctgatgaagaaattaaagttgttttaggcaaattctcaacttatagattgagagtagaagagaagcattgatagtacgagagtaacaactatattattaaatatatgcttgcggatagtacttctccgtcaattgcaccaacattgccagcgagattgttggcaatgtggtggttaatcctcttgcctctatatcattttgtaacacaaaaactgtcttgttggtaaaaagttgtgggtattttaccgcttgtaatacgccatcttgccataacacgatagcatcatcaggggtaacttgttcaagaatagcgtttagtgttgataagtcatattgtgctttggaaaacgtatagagcatagtatgtccttagaatgtgagtactttttcggcttgatgcagggtatcaaataatgctgttcggctaacaaaacggagttcgggtagtatccattctgcgtgatgtagcccacgctcatctactgattgttggcagacaaaacattcggttaaatcatagagatcgattagcttgaatgtggatatgtgatctttttgtaaaatcatttcaggctgttgattagcaactagattgaatacgccatcattgagaaagcaaatggcaatttcatcttcattgcaaaaagcactggcagccaatagagcatcaagaccttctcggcttgttgatgtgccaaatgggggctgagtaaagagaatagcaagtttataacgtttcattttaaatagtcagtaatcgatctgcagtaaataccgcttggctaaattcaccaagacctgcaagggtaaaaccttcagcgagattttgctctacaatgccacgccgttgagcagctgcaatacagagatgtaacgacaagcggtgagattgggctaagcttttccaagcctcaaccaaattcagttcatcgctggctggatcaataagttgatttgcattgctaaccccatcttgaaaaaagaagatttgttcaattctatgcccctgatctaaaagtgcttgagcaacttgataggctagatacgccccttgtgagccatacaccccgtgttttactgccaacacatatcgcattattcaccgtcctgtttgagctggcgaatgtagagataaaccgtgtggcgagagatctctaagcggtcagcaacttggttgattgcatctttaatatcaaaaatacctttttcaaataaggcggtgacaatatggcggtttttattgctgttagaaatgttgcggtcgttttttatttcgacaatggtgctttcgatggtttgagccactaagtcttcgacagagcttgcaaaattcactgagccttcgctctctggtagggcaataaaactatttaaaaattgcgatacagggatatcaagattgatattaatgcaaattaagccgataacgtgttgtttaccgttgcgaatggcaatggtgacagatttcattaatactccacccttggcgcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcattaatactccacccttggcgcgagtgaaataaggtttggatacgctgtcggtttgcatatgatgaagtgaccacaaagcccgatctgtaatcggcgagccaattttacggtcagtattatgcccattgacgatataaatcgcagagtgttctaaaaattcaagggaatgcagtacgatttcacaatgctcgccaatgagagcggcaataccatcaacaacgggaaagtaggaagccaaaatggcgtgatcttcatcagaaagcggattgaattttgctgtcatactttttcgctacataaaattaaaaataagggcacaaattgtgcccctataatgcgtttaagtaaacttattttgctggtttaaaatctaataattcgatctcaaattttaatgtggagtttgctgggatttttcctgcttgacggtcgccgtatgctaattgtggtggagcaacaatttccattttgccaccttttttcaacatagggattgcttcaacccaagctggaattaattgatttaattgaaattcaatcggctcaccacggtcgtaagagctgtcaaacacagtaccatctggtaatgtacctttataatgtacttttactgtatcagttgcttttggtgcttcgcctgagcctgctttctcaattttatagagtaacccagattgagttttcttcacgccggatttttttgcatattcagcacggaatttatcgccagcctcaatggttgctttacttttttctgctaggattttagtttcttgttcaactaaataagcatctaacgcttttaattgtttttgtaaatcttcatcggttaacttaccgctttttttcaatgtgtcttgcacaccagctaaaacacgttcttggttataagaaaaaatctctttttgagaagaaataacatcttcgatatttttacccatcaatacgcccacagcgtaagatgaatcatcaacaaatttagtatctgctttttctgcaaacgcagcttgtgcaataaacagagagcttgtcattactgcaagagcagaaaatttattttttaacatagcttttccttgtaaaaatcattaaatagtttgttaaaacaaaggtagatagggtaaagtgtatttctttttaacacaacctttatattttgaaatgtcagaaaatttcaataagataactacctctttggcggagttagaagctaaaatcgccttccaagatcatacaatcgaggaacttaatcaagctctgattgcccaacagtttatgctagaaaaactgcagtaccaagtgcgtcatttagctgaaaaattgcacagtgttcagccaagtaatgttgcaagtcgtgcagaagaaacaccaccaccgcactattagagtgatatttagtgattttgttcaatggataacataatgaaatttagaaattggatctattttattagcttatggctatttatatcttcgctttttgcagaagaacctacaaaaacacctctattccaagatggaaaaggctactactcttataaaaaaccattagatattttattaccgaaagataataaggtgttaattacttatttttatcagtatggttgtgaagtctgtttaaatggtgatgattatttaaaacaatacgcttctcgacactcagataaagtggttttagaacgtgttgccgcttttagtgagaataaatatggcatcacagtaagtttaaatgcacttttttcagaactgggaaaacctgaattaagcgagaagtatttatttgatagctcttatcaaaatgatcgacttattaccaatgatgaagcaatagccaaatggttgcataagaatcagatttcgttggatgccgttgaacaaacaagaaaaaaggaaaattatccgaaaagaatctcacaaaattatgaattaataaaacgctattcaccgccagtcattcccatggcggtattgaatggtgaatatattttaactaaaagtactctttataatgatgattatacctacgccgtactcgactttttagtcgataaattacaaaaagagcaacaaggagtcacaaaatgaaaattggcatcataggtgcaatggcacaagaagtcgaaattttattaagttatatggcagagccgaaattaacggaaattgcaggttgtaaaatctacgaaggcaaaattaataatactgatgttgcattattgcaatcgggtattggtaaaaccgcctccgcaatgggaacggcattattattacaactggctaaacctgaaatggtgattaatacgggatctgctgggggtctagacgctaatttgaacgtaggcgatattgtcatttcaacggaagttcgtcatcacgatgtagatgtcaccgcctttggttatgaaaaaggacaactgccagctaatccagccgcctttatggcaaacgaacaacttgcacaaattgctatcaaagaaaccgagaaagcaggatttaatgcagtatctggtttaatctgtagtggcgatctgtttgtgaatggcagtgatatgattgctcgtattcgcaatgatttcccgtccgtaaaagccgtggaaatggaagccgcttctatcgcccaagtgtgtcacgcattccaagtgcctttcgttgttgtgcgtgcaatttctgatgtggcagacaaagaatctcatctctcttttgatgaattcttaccgcttgctgcagaaaaatcgtctgaaattgtgttggcaatgttgaataattttgcctaatcaaaacagcaagaggtaatttatctcgtaatatttgcaaattttaaccataaaaaaaccgcttgttgtcgaaatttatcttcaaattttgtacaattctgttcctttagcctatgctttgcataggcttgtttatttgattatctatattgttgagattgttttatgagttcagcaccaaatatcggctttgtgagccttggttgccctaaaaatttagtcgattcggaacgtattttaaccgagcttcgttcagatggttataacatcatttccagctacgaaggggcggatttagtgattgtcaatacttgtgggtttattgacagtgccgtgcaagagtctttggaaagtattggcgaagcattagaagctaacggcaaagtgattgtgacaggctgcttaggggcaaaagagaaccaaattcgtgaagttcaccctaaagtcttggaaattacaggaccacatagctatgaagcggtgatgaaacacgttcataaatatgtgcctaaaccagaatacaacccttatgtcagccttgtgccaaaacaaggcattaagctaaccccgaaacattatgcttacctgaaaatttcggaaggttgtgatcaccgttgtacattctgtattattccatcaatgcgtggtgatttagacagtcgtccaatcgtacaagtgctagatgaagcgaaacgtttagtggattctggtgtcaaagagctgttgattgtatcgcaggacacttccgcatacgctttagataagaaaaaagaagaaggcaccaaaacggttttctggaacggtatgccaatcaaaaacaacttgatcaccctctgtgaacaactaggttcaatgggtgtttgggtacgtttgcattatgtttatccgtatccacacgttgatgaccttattccgttgatggctcaagggaaacttctgccttatttggatattccattgcaacatgcaagtccaaaaatccttaaagcgatgaagcgtccaggatctattgaccgcacattagaacgcattaaaaagtggcgtgagatttgcccagatttaaccctgcgttcaacatttatcgttggtttccctggagaaacggaagaagatttccaaatgttattggatttcttaaaagaagcacaattagatcgtgtcggttgttttaaattcagccctgttgatggtgctgttgcaactgaaatggaagatcaagttccagaagaggtgaaagaagaacgcttccaccgctttatgcaattacaacaacaaatttcggcagatcgtttacaacagaaaattggcagaaccttgtcagtgattgtagatgaaattgatgaagaaggaataattggtcgctcaatggcggatgccccagagattgatggcgttgtctatgtagataacctttcaggtgcagaagtgaaagtaggtcaaattatttcagtaaccattacccaagcagatgaatatgatctgtggggaacttgttaagttttattaaggaatttgtataaattcacaatcagcgtagcttttcaatagctaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagatctgtttagaatttttccactctcaccctctatttatttagcacctgcaaccctcagataaggtactcaaatattaatgtaccactatagagctccttctgactcttcaaataatcagcataaatatattgtggagatgttcaaacaacgctacgatgcagatgcttcttctagtttgatttgaatgctccttactatagggttattttcttaatagttcgtatgtgaatcatggataaagtgtaacagtaaagatatttcttctaatttcaaaaaattcccaaaatttcatcgcttacacgttataatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaacatttttgaatgaatttttaggaaaaagacaatgacagcgaaatttaacgtgaaaactttccaaggtatgattttagccctacaagattactgggcaaaccaaggttgcaccgttgttcaaccattcgatatggaagtcggcgcggggacatctcacccgatgacttgtttgcgtgcgcttggccctgagccgatggcgtttgcttacgttcagccttcacgccgtccgactgacggtcgctatggcgaaaacccgaaccgtttacaacactactatcaattccaagtggtaatcaaaccatcaccggataacattcaagaactctatttagacagcctgaaaatgttaggtttcgacccaacgcaaaacgacattcgctttgtggaagacaactgggaaaacccaacgctaggtgcgtggggcttaggttgggaagtgtggctaaacggtatggaagtgacacaatttacctacttccaacaagtgggtggtttagagtgtaaaccggtaactggcgaaattacttacggcttagagcgtttagcaatgtacattcaaggcgtggacagtgtgtacgatcttgtttggtcggacggcccacttggcaaaaccacttacggcgatgtattccaccaaaacgaagtagaacaatctacttacaactttgaatatgcaaatacggatttcttattctactgtttcgatcaatacgaaaaagaagtgcaagaattattggcattagaaaaaccgttaccgttgccagcttacgagcgtatcttaaaagccgcacatagctttaacttacttgacgctcgcaaagcgatctctgtaaccgaacgccaacgctacattttacgcatccgcaccttaaccaaaggcgtagcggaagcctactatgcaagccgtgaagcgttggggttcccgggttgtaagtaaaatctccccctaccccctctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaaagagggggaatttgaatgaggtaataatgactaaaccaattttatatttcgcccactggtgccctgataccgccccgtttgtcgctgaattacaacgtcttggtattgactacgaagcggtggatattacccaaagcggtgcaaatttcaaaccatttctcagattgcgtgaccgccaccctgcgtttgatgacgccaaagcaaatggctatatcggtattcctgctttggtgttggaagatgagagagtggtgttagagttgggggagttggagagattttgcaatcagtgattgcataattgaatttaatgcatcttactcaactttttttgttcttaacgtcccaataaagctagagaaataaggaaatttatgaaatacgcttttattgattatgaaaatgtgaattcattagacggtttaaatttacaggaatatgaccgcacttttttatttatcggctcggtaaataaccagttgcgtttgactgaaaaatttaatgatgaaataaacattaccttaattacggtaaaagatatttcaaaaaacaacgtagattttcatcttacttattatttaggcaagttagatgcctgcgttgataaaaatattgagtttcatattttatcaaatgacaaaggttttgatggtatttgccaatttattcaacaccaacgagaaccgagaatttgttttagaaaagcgattaaccaaactgaagaaaaaatcgctttgccgttattgcctagccaagtaacgaatgtaaataatgcagaaaaagagaagattgttcaggtagctcaagaatttaaggcatttatatcaaaagtacaaaaacgtagtttgccagttaaattagctaccttaaaaaatagtatctataatcaaacaagtcttaaaggtgttgataaaaaggaagctgataaattattgcctaaaattattgatcagttggttcagaaaaagttgattaaggtaaatgaaaataaagtaagttatccttaatttttaacaactaacaagcggtataatttcatagatcttttgcaaattttttcaattcgagacgcaatgcgtctcaaattcggaactcactgcgtaccgaattgaattagagttgaaagagcgaagcagagatttgttgaagctaaaagtgaataataatgcaaccttattcgagagatttaaaaccactttcgcaaaagttacgttctacacaaacggaagcggagcgtaagttatggcaaagaataaaccgagatcagctgttaggatttcgctttaatcgacaaaagccccttttaagctatattgtggatttttattgcttaaaggcaaaattggtgattgagcttgatggaagtcagtattatgagccggattatcaagaaaaagatcgtttgcgagatgcggagctaaattcgcttggctttacggtgatgaggtttgataatcatagtgtaatgacaaatattgatggtgtagtggaagcgatttatcagtatttgagtgagataaaagtggaagaaaaatagcgtaatttcttcggaaatagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgaaaatgaagtgagagatttatacttcaatataatttaggagcatataaaatgaattattggctagttggtgctactaggggtggtgaagaagaaatcttagattcctttattgaaaaaggttattggtactgttgggattctaaagattataaaccaaatcccgagggtttttctggaggtaactctataatacgccaacaaaactcatttagaaagatcaaaaaaggagatcgaattgctgttaagcgtttacaagggcaaggttcaaaaatgatggatattcttgcaatagggattgcaagaacagatgctgatgaaaatgaatggagggtatatattgattggattgcgatctctcctaatttattagaaaaagatgagtttaagaaacttgataaattaccaaatattgtatttccatctacaagagaaattgaaattggggagtgtagagcttctattcatggtccgtataagttagaagaaaataaagagtggattccaaaagtattctttatttaaagaatttttagcataagagattaataacaaaatgacaacacaaaacttcctcgccgagatcggcacagaagagttgccaccgaaggcactcaaaaaattagcgaccgcgtttgcggagaatgttgaagcggaattaaaccaagcgggtttgagctttgacaaagtggaatggtttgcagcacctcgccgtttagcggtgaaagtattagggcttgcgactagtcagccaagcaaagaagtggaaaaacgtggtccggcggtgtcggcagcgtttgatggggaaggcaaaccgaccaaagcagcggaaggctgggcgaaaggctgtggtattaccgttgagcaggtggagcgtattgctaccgataaaggcgaatggctggttcaccgagcggtgattgaaggtcaaccgaccaaaaacttattagtcggtatgattagcaatgcgttggtaaaattgcctatcccgaaaacaatgcgttggggcgataaaaccgagcagttcgtgcgtccggttcacacggtgaccttattgttaggcgatgagctgattgaaggcgaaattttaggtattgcaagcggcacgactattcgtggtcaccgtttcttaggcgagcgtgagttccaaatcagccacgccgatcaataccctgcgttgttaaaagaaaaaggctcagtggttgcggacttcaacgagcgtaaagcgttaattcttgcaaaagcccaagaaaaagcggccgctttaggtggcgtggcggatattgaagaagagttgttagacgaagtgacttctttggtggaatatccagacgtgttggcagcaaaatttgaagaacgtttccttgctgtgcctgcggaagccttagtttacacaatgaaaggcgaccaaaaatacttcccgatttacgataaagacggcaaattgctaccgcactttatctttgtgtcgaacatcaatcctgaagatccaagcaaaatcatcgaagggaacgaaaaagtggtgcgtccacgtttgaccgatgcggaattcttcttcaaaaccgacttaaaacagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttaaaacagcgtttggaagatcagttaccacgtttagaaacagtgttgttccaacaacaacttggtacattgcgtgacaaaaccactcgcattgaacaacttgcaggcgaaattgcaaaacaaattggagcggatgaaaccaaagcgaaacgtgccggcttgttgtcgaaatgtgacttaatgaccaatatggtgtttgagtttaccgatacgcaaggcgtaatgggtatgcactatgctcgtcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtatgcactatgctcgtcacgacggcgaagatgaagaagtggcggtggcgttgaacgagcaatatatgccacgctttgcaggcgatgagttgccgaaatcgttggtggcaagtgctgttgcgttagcggataaattcgatacgctcacgggtattttcggtatcggtcaagcgccaaaaggcagtgccgacccattcgctttacgccgtgcagcacttggtgcgttacgcattattgtagagaaaaacttaccgcttgatctgagcgatttagtggcaacttcagcgaaattgtttggcgataaactcaccaacagcaatgttgtagaagaagtggtggactttatgcttggtcgtttccgtgcgtggtatcaagatgaaggcattgcggtggacgttatccaagcggttctcgctcgccgtccaactcgcccggcagactttgatgcccgtgtgcgtgcagtgtcgcatttccgcacgttagatagtgcagaagcattggcggcagcgaataagcgtgtgagtaacattttggcgaaagtagaaggcgaaatttcatcagaaatcgaccgcactttattagtggaagcggaagaaaaagcccttgcagaacaagtaattacattacaagcagagcttgcaccactgtttgaaaaaggcgaatatcaaaccgcacttgaccgcttagccggtttacgtgaagtggtggataacttcttcgataaagtgatggttaatgccgaagatccaaaacttcgccaaaaccgtcaagcaattctaaacaacttacgtaacttgttcttacaggtggcggatatttcgttactgcaataataacaaatgataaagccctattcacaaaatagggcttttttatggtggtagaatggatttagacaaattaattgagattgaccaaaagcacatttggcacccttattcatcaatgacccaacctatccctgtttatgcggtggaaagtgcaaagggtgttgaaatttaccttaaagatggtcgaatgctcattgacggtatgtcatcgtggtgggcggcactgcacggttataaccatccacgtttaaacaaggcaatcacagaacaattagcgaaaatgagccacattatgttcggcggtatcacgcacgaaccggcggtaaaattaacggaaaaattgctgaccattttaccccaatcattgaacaaaatattttttgccgatagcggttctgtggcggtagaagtggcattgaaaatggcattgcaatattggcaagcaaaaggggaagatcgaaatcaatttgccaccgtacgatcaggctattacggcgatacttggcacgcaatgtctatttgcgatcctgttacaggtatgcacggtttgtttcgtcaccgcttacctattcaacattttttaccccaaccttcgattaaatttgatgaagaatggcaagaaagtgcgattgaaccattgaaagcattgcttgcacataaaggaaaccaaattgcggcattgattttagaacccattgtgcagggtgccggcggaatgtatttctattcgccgatgtatttaaagcgagcgagagaactttgcgatcagtatggtgtattgctgatttttgatgaaattgccacaggttttgggcggacaggcaaactatttgctttagaatataccaatgttgtgccagatattctttgtatcggcaaagcattaactggcggttacttaacattagcggcgactattactaccgagcatattgctcataccatcagtgaaggcgaggcaaaacgctttatgcacggcccaacgtttatggggaatccactggcttgtgcggtagcctatgaatctctgtcacttttactggaaagcgattggcaacataaagtccatcaaattgaagcgcagctcaaggctgaacttgcatcggctaaagcgtttaaatccgttgctgaagtccgtgttttaggggcgatcggagtgttggaaatgcgtgaagcggtcaatatggtttctttacaaaaacgctttgtagaaaagggaatttgggttcgtccttttggtaaacttatttatattatgccgccttttattatcgaacctaaacaattaagctttttaaccgagcaattattagccgtggtcaaagaggaatacgatgaataaatttactcaacatcttcagcaattagctgaaattgggcagaagcgccaattccctgatattgaacatcagggaaaatttgttgttgctcgtggtctgacgatgttgaatttatcgtctaacgattatttgggtttggcaaatgatgcacaacaagtggaaagatttttgcaatctatcggtaaaaatcaaccgcttacgtcatcatcttctcgtttattaacgggcaatttcccgatttatcaggattttgaaacgctattagcacaacgttttcatcgagaatccgctctattatttaatagcggctatcacgccaatatcggtattttgcctgcggtggcggataaacaaactttaattttagctgacaaattggctcatgccagtttgattgacggcattcgactttccagggtggattttttccgttataagcataatgattatcttcatcttgagcagctattgcagacacattcagagcgctaccaacaagtgattattgttacagaaagtgtttttagtatggacggcgatattgcggatcttcaacagttagttgcactcaaaaaacgttacaccaatgtgctactgtatgttgatgaagcccacgccataggtgtatacgggcagcaaggtttaggaatggcagaagtcttcgactgtattcaagagattgactttttagtggggacttttggtaaggcattggcatctatgggggcttatcttgtttgtgatagcgagataagagaatacttaatcaatacgatgcgtcctttaattttttctaccgcacttccaccgattaatgttgcttggacttactttttatttgaacaattaccgcaatttactgaaaagcgtcatcatcttgagaaattaagccaaatcttgcgaactgaagtgacgaaaagaagtgaatttccgctgctaagcgaaacttgcatcgtgccatatatcttaggcgaaaatcagcaagcggtggaaaaagccgattatttgcaaaaacaaggctattattgcttacctattcgtccaccaacagtgccaaaaggcacggctcgtctgcgtttctcattaaccgcagatttaaccgaacaagatataatgggcttaattagctgtttgtaaaaggagaaaagcgtgcgttatcaacacattacacgccaacaacgtaaattacttgtctatttttctggctggggaacgccaatcagcattgcgaaatctttagagttaccgaacgattttgatttactgatttgttacgattaccgagatttgcatcttgaatttgatttttcgggctatcaagaaatttatgtggtggcttggtctttaggcgtttgggtggctgaacgtgttttacatgctattcctttgacttacgctgtggcgatcaatggaacgggggcacctaaacacgatcaatttggtattccaacggcagtgtttgacggtacgctttcatctttaagcgaagaaaatcttgtaaaatttgaacgcagaatgtgcggtaaaattgccctagaaaattaccgcttgttacctgaaaagcgagatttcacagaagtaaaacaagagttagcgcacttaaatgattgtattatgcaagataatcgaacggggttgttagtgtggcaaaaagccattattggcaacaaagataaaattatcccgccacaaaatcagcttgaatactggcaaaatcaaccacaaacaaaaattcagctcattgacgcagagcattatctttttaatcacttttccggttggcaaaaactgcttgagggtgtgacgtgcagttagtggataaacagcaagtcgctatccgattttcacaagcaaaatcggaatatgataataatgcgattgctcaacaatgtatcgtacaaaagctgatggcattactcgcaacccaaggcaaagcttttggcaaaatacttgaaataggttgcggcacaggtatgttaagtgaacaacttatgtcgcattgtgagtttgaatgtttagtactaaatgatctttgtcgcgattatgagcctgctttacgcaaaaaattaccttattcttcggtacattatcacttcggcgacgcggagcgggaaaatttcggcataggttatgatttggtgatttccgcttctgcaattcaatggtttgaaaatgaagcgaacttcctgaaaaagacggctaacatactgaatgatgacggtattttattgtttaatacattttcgcctaaaaatctttatgaaattaagtatctgcttaaaacgggattaacttatcccaccgaagacgaatggtataaattattagccgatggatttgaagttcttgttttaacaatggaagaaattcccctttattttgattgtgcattatcagtactaactcatttgaataaaacaggggtaagcattattgatccgtctaaatggtcggacaatcgtctaatgcagtttgaacagcgttatcgtacgcgatttcagcaggatttaggcgttacattaacttatacgccactttatgtaatggctcgtaaaaaaaggaaacaacatgcttggtaaagtgatttttgtatcgggtattgatacggatgtaggaaaaaccattgcaacaggtttttatgctaagacattgcaggaacaaggtttttccgtgattacgcaaaaaatgattcaaaccggcggtgaaggaattgcggccgatattttagtgcatcgtaaaattcaaggcattgatttattgcctgaagataaagcaggtttaacttgccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgtttttccttatccttgttcgccacatttagcggcacgtttagcgcatacggaaattgatgaaaataaaattaccaatgcagtaaatcaattaagacaaaagtatgattatgttttgttagaaggggctggtggactggctgtgccttataccgaaacgagaaccaccttagattatttaaaaacacagcagtattcgctcattttggttagttcaggtaaattaggcagtattaatcacacattactcagtttgatgacgtgccaacaatatcaaattcctttagaagcactggtttataatcgttatcttgatcaagattcattgatcagtcaaaatacagaaatctatttattaaattatttacaacaacattttccgaaagcgaaatttattggtttagataaaatcgatatttaacacaacatattaagaggtaaaaaaatgtcagtcaaaagcgaagtgttattcagtaatcagtgggacgtacgtatcagcgatccagggttagaaggggcaatgagccactattttgaaacggtttatttaaatctcaccgctcacattgatgcgaacaaagtcagctacgaatttacccgtaaagtcgaaaatgaagtgcaaacccattgcatttttcacagtgttgatgaactgtttaaattcttggcggaatatcttgggccagttgcactgggcaatattggtgtaaaaattggtaagttaggtttggcttaattgtctatgagcaacttcctttaccatcaaacccaactgtattgggactttttacgcattgaaaagcaagtaagcccccatacgctcagcaattatcaacgccaactacgagtggtttgcgaaatgttacagcaagcagaaattactcgttggcaagagcttgatgcatcgacggtacgttggattttgtcacaaagccataaacaagggttaagtgcaaaaagtattggtttacggttggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcactacgtcagtttttggcgtttttggtgaagcaaggggaattaaaagtaaaccccaccttaggaataaaatcacctaaagccaataagcatctccctaaaaatattgatgcggaacagatcgggcagttgctaaatatagacagtaacgaaccgcttgatctacgagatgtggcaatgatggaattgatgtacagctctgggctacgtttgtctgaattacaagggttagatttaggcgatatggatttacctaaccgtgaagtgagattgctcggtaaaggaaacaaagaacgtattgtgccaattggttctaaagcattagatgcaattgaacagtggcttgcagtacgtgggcagtttcagccaaaagacaacgccgtttttcttaatcagcgtggtgggcgactttcccaccgctctattcagttggcgatgaaaaaatgggggcaaaagcaagcattggatacccaccttcacccccataaattacgccactctttcgcaacgcatatgttagaagcaagtcaagatttacgggcggtgcaagaactacttgggcacagtagtctttcgacaacacaaatttatacgcatcttgatttccagtatttggcgagaatttacgatttggctcatccaagagctaaaaggaacaagtattaatttagatatacattcaatactctatgatagtatacatatggagattaaggggtgaaaatgaaaaagtttgatgaactcgaagtggatgatacagaatttattgactctaaagatgcagagctagttgatattgacaataatgcttcaaatatttgtatcacaaataatatgttagtgcctcagggagcgacgctggatagttatattagaatggcaaatcaatatccagttttaacagctgagcaagagaaggagttagcggagcgcttttattatgatgaagatcttgatgctgctaagcagttaatcatgtctcatttgcgttttgttgtgtatatcgctagaggttacttaggttatggattaccgttagcggatttaattcaagaagggaacattggcttaatgaaagcggtaaaacgttttaacccagagatcggtgttcgtcttgcttcttttgcggtacattgggtaaaagcagaaatacatgaatatgttttaaaaaactggcgtattgtaaaagttgctacaacaaaatctcaacgcaaactattctttaatttgcgtaaaaataagcaacgtttggcatggtttaatgaagaggaaattagaaaagtcgcagaagaattgggagtctctacagatgatgtcaaagaaatggagtctagaatggtcggacaggatataggctttgatacctctgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataattatgttccctccatgtatcttgaagatgaatcttcaaattttgtagatgaattagaatatgaagagtatagcggaagggcaactgctcaattagcttatgcattagcacaactagatgaacgtagtcaaaatattattaaaactcgttggcttgatgaaaataaggccactttacacgagttagcggctcaatataatatttctgctgaaagggtaagacagttagaaaatcaagctttaaaaaaaattaaggatgtaattacttacgatataacatagtagacaaaaggcatatagaaaaaatacctagtgctttgaataaaacttggatactcaataatagggggggcactacgctatgccgaaaagctacgtccgtaaggagaggtaaggaggttaaagcatgcttcagcaattcttttatacattgagtgagatgaagctaaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttttgtctactatgcctaaaaaacaggctaatcatcattaacctgcgaattgatgaacacagcatagcaattttacatgttaattgataataattatcgttttatttgagtgctatattttgtcaaggtataatctttcattttaaagagaaagttgtatttgcggagcttgggtagcaaaatgaggaaaaacagcaacttccgctttataccatttttgaataatctctttttggataacctctgctgcactgccacaggcttggatatgctgctctgctagtaaaatcagttgatctccatatagcgaggctaaattgagatcgtgcaaaatacaacagaccgttagccctttcttttggcatagatttttgagtaaacgtaggcagtgttgctgatggtaaagatcaaaggctgaggtcggttcatctaaaaatagcaatttacctcgcatatcttcactccaaagttgtaacaacgctcgagctagttgtgtgcgttgttgttcaccgccagagagctgtcgataagccttatttcgcaaagccgtacattctgtcaccataatcacctcttctaaatgctgatcgacttccgtttggcttcgatgatagcctcccattctaatcacctcttctacagaaaaaggaaaattgagtaggctatgttgtcgcattacggcacgatgttgagccaattcagctaaagagaattgatctatacctttattatacaaacgcacttctccgctttttgccgagaggtagcctgataataggcgtagcagtgtggatttgcccgcaccattaggaccaatcagcactgtcaccttaccttgtggtaacgctaaagagatattgtctaacaaaagacactgattaatcgttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatcagcgatcagtaagcggtctgattgcaacattaatttacctccctataacgaatgactagccacagaaaataaggtgcgccaagaaaactggtaatcataccgacaggcaattccgctggtgcaaatgcagttcgagcaaacgtatcagcgacaagtagcaagattgctccacaaagagccgaagcgggtagaacccaacgatgatcagcacctaatttaaagcgaacaaggtgaggaatgactaaaccgataaacccaatcgcaccactcactgctacggcagagcctactaataacgccccaagtaacatcaacagtcgttttagttgtagtacattaatgccaagataatgagcttcttcatcaccaagttgtaacacattgagcttctgagcgagagtaaacaaatataaacaggcgggtaaaatcagcgtacttgcaataaataacggctgccattgtgcttgtcctaaacttcccattgtccaaagtgtaaattgacgaagttgctgatcgttactgatatatgtcagcattccgacaatagcaaaacaaagtgcgttcactgcaatacctgccaataacaatttttgcatagaggcttgagtacgatgacttaaggcatagataaacccagttacagcaaggctacccataaaagcaaaaagcattgtgctataaatgccccactctgttggtaaaatatttggcaacagaatagagagggcgacagcaaggcttgccccgctatttacaccaattaatgcaggatctgccatcggattatgaaataacccctgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaatgatggcgagtaaaatacgaggtaaacgaatatttaaccatatttgccacacattactgtttaggtctgctgcaactaagtcttgccacgtcaaagaaaatgcaccgatatttgttgcaataagagccacaagcagtaatacgataagtagtgagatcagccaaagggaacgggacattatttcaccacttgttcagccgcagtacgcattttttgtagctcttgccccattgttaatccgaaagcaagaaacgcaatatcatcaacaacaactaatcgcttatgttttcctgcgttggtatgtgcaagtccaggtaatgtccaaatttcatcgggagatttaaaattctccaagctcaaatggctaagcacgatcaaatcaggatttgctgaaatcattccttcttgagaaatcggagcaaatctcaccgcgtctttcattgcattttttgctccaattaatcgaatagctgtatctgcgactgtaccttttccagccgccatttgatgtatgccagctcgattgagaataaataaaatattgacatcaagtggagatttattgaccgcatttatttcttgggtaaatttatctgctaaagtagccgcttgttgtggcttaccgacaatgtcaccaatgcgtttgattttttctacgacactttcagggctatatttaagcggtacgagttccacctgaataccagcagatttcagttgttctaatacaatagatggctgcgaaacctcactcgcaatcactttagttggttttaatgccaaaataccttccgtattcagttgtcgcatataaccaatatcgggtaatgttttcacctgtggaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaggcttgtactatcacgcccaattaaattttgttctgcatttaaggcataaataatttcggtgacatcgcccccaatgctgatcacccgttcatttgtagcctgtgcagttatagaaattgcaaaacaagcggtgagaaaacagaaaaatcgaatgaatggcatataaacctcctaaatgataaaggttctcattttatattattgagaattattatcaagtgattacataccccccactcacctgcttcactacgcccaacaactccaaattcagcagctcaatcaatgcggtttctaccgccatatccgtcgctttggcaagatcatcaatgctgatcggctcaaggctaatctgttcaaacaattgttgctgacaagcggtcagttcaggtagattttttgcaaatttgggttcggatttcaccgcttgtttaggtttcgtatcaaatagacttggttgaatatgcactgattgccgttgccacacaatcgcttctaaaatgtcgtcaatattttcaaccagtaatgccccttctttaatcaatttatggcacccttcgctatacgggttttgtactgagttcggcaatgcaaaaacttctcgtccttgctctaacgcataacgagcagtgatgagcgagccactgttcaccgtggcttcaataaccaatgtgccgagagataatccgctgatgatgcgatttcgtctagggaaattttcagcaatcggtggctggctagggaaaaattccgacactaatgcaccgcttgtatcaacgatttgttccgcaagttttttgtggcgggcaggatagacttggtctagcccactgcctagaaccgcaatggtaattccgttttcattgaccgcacgttgatggcaaaatccgtctatgcctatggctaaaccactagtgacagcaagttgatgtttcactaattccgccgaaaaatgccctgcccagtgttcgccatagtgggagtaatctcgactgccgacgatagctatctgcggtaacgataaactttcaacattcccccgcacaaaaagcacagggggagcagtactgatctgcttcaataaaaaaggataatcttcgtcaaataaggttaaaatctgttgctgatcctgttccgcccattgtaacgcctgatcaatccatttatgctcaggattaaaccaacgctgaatttgccgttcattccagcccatttgctttaatgcggttttgtcatattgacaaaattcgccaaagtccacttccgagagtaaccgcccgatacgttgcgcgccaagctgtggcacttgtaacagggctaataattttgtgagatgtgtcatttattatttaccttatcgtagaaatattaaatttacttcgatctcactcccctctttagaaaagaggggttgggggagatttgacagaagtaaataacgaagaaaataatttatttggcaatcaataataaaaaaactaagggctttttaatcactcacttcgtttattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaagagggggatagctagaggctagaaaaatatattaatggtaagctcccttctacatacatttccctaatcctaataaaaagtttaaaatagccaacatattctttttaatttttcgacggagatcgcaaaaatggctgttttagacgttttaatttacccagatgagaatttggctaaggtttgccaacccgtagaaacggtggacgcagaactaaatacctttattgataatatgtttgacacaatgtatgaacacgaggggatcgggcttgctgcaccgcaagtcaatgtgcttaaacgtgtgattactattgatattgaaggggataaaactaatcaaatcgtgttgattaaccctgagattttggaaagtagtggagaaactggcattgaagaggggtgtttgtctattccaggttgtcgagctttagtgccacgcaaagagaaattgacagttaaagcgttaaatcgtgaaggtcaaacgtttacgcttgaagcagatggtttgttagccatttgtattcagcacgagatcgatcacttaaatggtgtgttgtttgtggatcatatttcccaacttaaacgccaacgtatcaaagaaaaaatgctcaaactgaaaaaacagattgagcgtgcgaaataaaggagaagacaatgattattgtaacaggcggtgctggctttatcggtagcaatattgttaaggcgttaaatgcaatcggtagaaccgatattttagtggtagataacctgaaaaatggtgagaagtttgttaatttagtcgatttagacattgcagattattgtgataaagaagattttattgcttctattattgcaggcgatgattttggcgaaattgatgcgattttccacgaaggagcttgctcagctacgacagagtgggacggtaaatatttaatgcaaaataactatgagtattctaaagagttgttgcacttctgtttagatcgccaaattcctttcttttatgcgtcaagtgcggcgacctacggcggtcgttcggacaattttattgaagagagaaaatttgaacagccgttaaatgtttatggctattctaaatttttgtttgatgaatatgtgcgtaaaattctgcctgaggcagagtcgccagtgtgtggctttaagtatttcaatgtgtatggtccacgcgaacagcataaaggctcaatggcgagtgtggcattccatttgaatacgcaaattcttaaaggcgaaaatccgaaactatttgaaggttcggaaacatttttgcgtgattttgtgtatgtggaagatgtcgctcaggtgaatatttgggcgtggcaaaatgggatttcgggtattttcaatctgggtacgggcaatgcggagtcttttcgtgccgttgctgatgcggtgctggcgttccatcaaaaagggcaaattgaaactattccattcccagatcatttaaaatctcgttaccaaacctttacccaagctgatttaaccaaactgcgtgcggcaggttatgataagccgtttaaaaccgttgcagaggggactaaggcttatatggagtggttgaatagataaaatgtaagcggtaagattgagctgaaatcttaccgctttgtcttttagatgtagtgaattccattaaaatcccaaatggagaaggtattttatgaaatataatctcatcgcattttctttgcttgcattacctttagtaactaaagcaaacccaacttgggtagatcatcaacgaataaaattacaagatcagcttgccagcattaaaacagcatttgagtgttgtatttggtgatgaagatttagataaccaagctcgggatcaaaatcagctacatcgtaattatcgtgagccgttggataaacataaaaggtatgacagtaaacaggttcgtgataataatgcatctttagcattacgttggtctaatggcgtaaaagcattgggagttgatactgatgtggatttagggattcgttctgggacagacatattcttacgtttcaaagtagctaaaacctggcaacacaatgaggtattttctactcgattagagcaaatttatcgatacggtatagaaagcaagcactatctccgcactaattttgaaaataaattccagtggaaacctcaggtttttatcaataatcatacctttctacaatatacccgtgatttagatgagaatgttgaatggggaaatagtttgtatcgtcagcacgattttgcgggctataaaaaattgagctatggtttatttgttggcggtaacatcaataagaaaaaagcggctctaactcactacggacctttcatcaactggcgacaaccaatttggaaagattgggtgtttattcagcctgaagttcatttttacaatgataaaaaacaaaatcgtaaacaccatttcggtgcttttttacgacttgaagcgattttctaacatcttttttaggcaaacaaagtaactatattacaaatagtgaaaatagcataatcaggcgattaaatattatctaactatttactatcccgacaatattcttgtaaatttaattaatatcttatttatagtaataatctattcttgtggtcttgccagctttttatagaaaaaagggtagactaattctgttatgcaatccattccactcagaaagcgattattagaaggctatttttgttaggttgggttacgttgagagatgtgtagaaacttgagttggcggaggcgtatgggagttgaacccacccgagaacgctggcatcctcaacaggatttgaagtcctgccacatcaccggatatgacacacctccgaaaaagtggcactattctactgaatttattagaattgtgcaaaatttctgacggatctctgctatgcaatcactatttcgttcaattcctgcaattgataaactgctaaaaatatcacaaggtgctgatttaattcaacaattcggacatcaagcctttgttgctcaagctcgtttactgattgaacaagctcgccaacatattcagcaacatcaaagtctgcctgactttctacaaacggaacatacgctttttaacgaattaactcaccgcttgcaaagccttgctcaagttaaaatgaaacctgtgtttaatctgacgggaacagttttgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattggagcaaatatataattatatttcctatgaataattttgtataaagcccctaattcttaaagcccacaaaaaagccctacattcaaaaaatgtaaggcttattatttagtacatctgcttaacatcgcaatcatagatttttgagaagcgttctagcgtttttttctgtggcttgctgtcgcttcgttccatttgagaaatagccccttgagaaatccccactttgtccgctacttcttgctgtgataggttgcgataaatccgccacgctcctaaatggtttacgttatgtttaatcattatcataacaacctcatgaggaattaacgcatcgtcattatcgctttgctcgtagggtaggctttcccattcttcgtcatcctcctcctctatcctaaagccgtactcgtctacatctactaacttttcatattccgccataggtaaaatcacatataaaggcttaccgctgttatctctgatatattgtaaattgctcattatttcttgctcctgtgttttatagctctagttataagtccgctcgtctcgcttcttaatctcttggatttcgataataatcggtttattgttcactactttaaaaattaccctataaaatcccactctcattctaaacttgcctttgtttttctcgcctttcagttcgataatatctgcttgaacatttggaaattgttgtaacgcttcgattttttcaataattcggtcaaggtatcggctatcaatagttcttatctgtttgcttgccctgcttgcccatctaatcacagccattttataacccttaagattaccctttcaatagaataattataagatactctataaatatattcaatctttatcttataattatcttatttattagtaatgatcgaacctaaccaagcatcgcacgtactgctccgaaattccgccaaaatgtgtagcataaaaagggatattatccgcagaaaccaaaacgccaccaatccgccacttttacgctttcaaaaaaatttttttatatttagtaaaaaacagtagtccaattagtccaattagtccaatcctttaaaatcaaacacttaagtggcattttttggactaatcgagtagtccaatgtagtccaaaattagtccaaaactaacaaaatactcttattgttcattttttgagtagtccaaaatgccccaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaattttatgtaatatattgataaataaagatattatttttttaataggtattttggactaattggactactaaaaaactacgcgcatgaaaaaaaattttttttgcaaagataaaaaaagagctaaccatctctggaaagctcttaaatcatcaatgtagcatacagaccacaaaaagcacttaatgatatggtttgttatggtttttatgcttcatcactttcaacaagtgggaaaacgagataacatcttgtacgtttcggatctatcctgcttggtattcttactaagtatctatagccattttcgcccttagatagcattcctttatctgataggattttacaagcctgctcctttgcgtgtccctttatcgcttcctcaaaggctaatggatacagataaaagtgctctatctcattatctcgttgaggaatgattttatagcctgcgatattcgagatggctcgctgttcggggttgtttgggtattcgataaaccgcccctcagcatttgctaatagccagccgttcacctgctcaatgatttgcttttcttcttggctatgtagtccaaaaatattgatccattcattaaagcagtgtaataacgcctcactattggcggtttcattccaaccagtgagaaagctcgctagctgtaaagcggtttcaaggatagcaaaacggctcgccactcgttgaacctgtggacttgcatcacttggtaagcggtctagccatttggttttaatttggctgtaagcattaatcagcgttttctgattgtccgccactgtaagccatttaatccacgctctaccaactgctccgtagtgttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtttgtggtcggaacaagcgatttcagctgctaccagtgcaatgcgaaataatgtggcgttggagtttgatattgaagcaggcaaacgtagtcaccgtgatctctatgtttctgagctgttgcaacaactgacaggggcggaagcggcttgcgtggtcaataataatgccgccgccgtattgctaatgttggcgacttttgctcaaggcaaagaagtgattatctctcgtggtgaattaattgagattggcggtgctttccgtatccctgacattatggctcaagcagggtgcaagttggttgaagtgggtacgacaaatcgcacccatttaaaagattatcgcaacgcaatcaacgaaaataccgcatttttaatgaaagttcacaccagtaattaccaaattcaaggttttacttcgagtgtgagtgaagaagagttggcggcattagggcaagagtttaatctgcctgtgattagcgatttaggcagtggctcgcttgccgatatgcaatccctaaacctacctgccgagccgataatgcaacaaaaagtcgcttcaggtgtggatttagtttcgttttcaggggataaactacttggcggtccacaagctgggattattgttgggaaaaaagcctttatcgatcaacttcaacagcacccactcaaacgcgttttgcgttgtgataaagtgattttgtcaggcttagaagctacgttacgccactatcttttccctgatcgtttaacggacgagctaccgacattgcacttgctaacacaatcccttgattgcttgcaacacaaggcagaacgtttaaaagtagcattaagtaagcggttagattatcgttatcttttgcaaattgaaccgagtgaagctcaaatcggcagtggggcgttaccgacagaaaaaatcccatcgcttgccgtgactatttcggcagacaaacagagcgatttacttgaattagaaaaacagtttaaaacctatccaaacccgattattgctcgttttgcacaacaaaaaatgtggctagatgtgcgaagtgtggcggagtttgaggtgcttatttttatgttggaggaactatgatcatcgtcaccgcaggacacgtcgatcacggcaaaacatcacttttatacgccttaacgggcactcacaccgctcacttgccagaagagaaaaaacgggggctgacgattgatcttggctatgcttatttgccgattgaaaatgatattttgggttttattgatgttccaggccaccaaaaatttctgtctaatatgctggcaggtcttggcggtgtccaacacgctttgttggtgatatcttcagaagaagggattaaaccacagactgaagaacaccttgctattcttcgcctgttgaattttaagcagattattgtcgtactcaccaaagcggacagagcagaagctactcgtataacccagctgatcgaacaattaaaacagcgttatccgtttttagcttcagcacatttctttgtgacttcggctcagacaggcgagggcattaagccgttaaagcactatctgatcagccttaatcaccaaagcacacaaatagataaaccgttccgctatgcgattgaccgtgtatttaatgtgaaaggtgcaggtttggtagtgacggggactgcagtcgctgggaaagtggctatcggtgatgaattttatctctcaagcggtcagaaagtgcggataaaaaacattcacgctcaaaataacgaagcatcgatcggggtagcagggcaacgtttagccttaaatatcgccaatgtggaaaaagagcagattgaacgtggcgactggattacacagcaggatccccaatttgcttgtgaccgcattaccgttcgcctaacgacagcccaagctttaaaagaaaacagtgttgtgcatctctatcactttgccagtcacactaccgcaaaattaaatttactggatagaagccaatgtcttgctgatgataccgcgatagccgaactgattttagatacgccgttacacattgctttgcaagacaaacttattttgcgtagtggcgacgatagtcaaacccttgctggtgcggaagtgatcgaaatccactcaccaaaacgccataaacgtagcgaagcacgcttgagttatctctcacagttagctaactgcacgagctatcaagaacgtattgcactctacctgcaacataaagcggtgaatttaacccaactactgtgggcagaacagatttttattcgtgatttagaaaaactggcggaaaaatcggattactatctcaactctaatcacctgtttaacggggcatttaaaactcagatccagcaacatattgtggcgacgctcgaagagtatcaccaacaacatagcgatcagcttggagtgacaaaggctcgtttacatcgtattgctacgttagagttatcagaacaacttgcctttgccctcattgacgaactgattgccgataacactttggcacaaacacgcggttggatccatacctcaacgcatcgaattgagttcaatgatgctgaattgcaaatttgggcagaaatccgaccgctatttgaacgtaccaatcaagctttatgggtgagagatattgcttccgaactctccatagacgaaactgaaatgcgtgacttgctatataaagcagggaagttgggctatttagtgccgattgtcaaagaccgtttcctattacacgaacagatcagtgcatttgctcagcttatcaaaaatttcattgaacaacatggcgaaatttcggtaaatcagcttagagatgaaattcaatatgggcgtaaagtgaccgtgcaactgatcgaatacttcgaccgttcaggcttcttacgccgtaaggggaatgttcatttgttgagggatagggatacttattaggagctatagagagtactaccatgcacggagacgaggaataaaatctgagaattttatgatgtgaggctaaaaacttggcgtagtagtctcctcaattggttcatgatgatacgtggattgcttgttacacgtaatgtaaaataatttgagcgaattgatagcttaaattagtaagattaaattttgttcattgtcttgaggtgcatctgaaaaattccaaattgttttgagaaacttcgatcttaaaatttacagagaagctggttcccctctttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatacggcgaagtgagagaataaattagatataagacacataagagcatatttaggtttgtcagcggtccgctccccgatggaaacattgggttttgcatttaggaggataagagtttttatagacaaagccagcattctatttttgcaatagattgtccacagaatagtccgttttaagcaaatcaaccaaatttacgtctaaagcgtccgcaattttccccattgcatcaattgaaatcgctctttttcctcgttctacatcactaatataagctcgactaagttctgcatcaaaagcaagagcttcttgagaaatatcctttaatcggcggatttttctaagattattcgcaaaagtatggcggattggatggctagtaagatgttcatttttcatctttttagtattgattctagcactatattcatcaatctacttaaagatataaaacataaactatagtttatattattataattttagattaatatatgatcgcaaaaattgatttatagatgaattttgcaagggcgtatgctctttttaataatatcgtttaatttctctagaaggattcttataatgaaactctcaattacaaagaaaactgtattaatagttgcaatgttaagtgcagttacaacaacatatgcggcaatgggctttttaattagagaagaagtaagtggaacaaataaaatttgttactatgatgtactagaatcaactcgtactatcaatgttccatcgtattctgtatgcccagtatcacataatttctaatagttttatggcgttcactttgaatgccatttttttaataattaagtttttcaaaatttattgagtttcttcttgttgccaaaaaaacaccaaattgctataatccgcaatccgaatttcgcatactggctagatgaattttcgtctagccattttgtgcttgaataacattagctaaatttgcgtcgttttagtttggctaattaattgatttataagatgttgttatgaatttatagatcgcaagcggtcgctttcgtgcaaaattgtgcaaagaccgttcccccctgagctaacctctgcggtagtgatttttgaccctttgtgtgaactcagaaaacgacacctcgtatcattttttataatgccacttcctgccggtcttgaggcggattgtgaaaactcaaccaaacagaaaatcagaggctatatttaatggcatactcatattccgagaaaaagcgtattcgtaagagctttggcaaacgctcacaagttctgaacgtaccttatctattaacaattcagctcgattcttttgataaatttatccaaagagatcctgaaggacttcaaggtttagaagcggcattccgttcagtgtttccgattgtgagcagcaacggtgcaactgaattacaatacgtttcttacgaattaggcgaacccgtatttgatgtgcgtgaatgccaaattcgtggtacaacctatgcagcgcctttacgcgtaaaacttcgtcttgtgacctttgatcgcgaagcggcagcaggcacagtaaaagacatcaaagaacaaaacgtctatatgggcgaaatcccattgatgaccgacaacggtactttcgtgatcaacggtactgagcgtgttatcgtttctcagttacaccgtagtccaggcgtattcttcgattctgacaaaggtaaaacccacgcttcaggtaaagtgctttataacgcacgcatcattccttaccgtggttcttggttagatttcgagttcgatccgaaagacaacctttatgcacgtatcgaccgtcgccgtaaattaccggcaacaatcattctgcgtgcattaggctacaccaccgaagaaatcttaaatatgttcttcgaaactgcgactttccacattgaagacaacagattattgatgaccttagtacctgagcgtcttcgtggtgaaaccgcagctttcgacattgaagcaaacggcaaaatctatgttgaaagtggtcgtcgtattaccgctcgtcacattcgtgcattagaaaaagacaatattactcaaatccaagtgccgaccgagtatatcgtaggtcgtgtgacagcgagagattacgttgatctttcaacaggtgaaattgtttgcccagcaaacagcgagatcggtttagaaacccttgcagcattagcacaagcaggttacaacgagatcgaagtattatttactaacgatcttgattacggtccgtacatttctgaaaccttgcgtatcgatccaacttacgaccgtttaagtgcgttagtggaaatctatcgtatgatgcgtccaggtgagccaccaacaaaagaagcggctgaagcattatttgacaatatgttcttctcaaccgaccgctatgatctttctgcggtaggtcgtatgaagttcaaccgttctttagatattcctgaaggcgtaggcacaggtatcttaagcaacgacgacatcattggtgtaatgaagaaattgatcgaaatccgtaacggtcgtggtgaagtcgatgatattgaccacttaggtaaccgtcgtatccgctcagtgggcgagatggcggaaaaccaattccgtatcggtttagtgcgtgttgaacgtgcggtgcgtgagcgtctttcattaggcgatttagatggcgtgaccccacaagatttaatcaatgcgaaaccaatttctgcggcagtgaaagagttcttcggttcatcacaactttcgcaatttatggaccaaaacaacccgctttcagaagtcacccacaaacgtcgtatttcagcgttaggttcgggcggtttaactcgtgaacgtgcaggctttgaagtgcgtgacgtacacaccactcactatggtcgcttatgtccgattgaaaccccagagggtccaaacatcggtttgattaactcgctttctgtatatgcacgtaccaacaactacggcttcttagaaaccccattccgtaaagtcgtgaatggtcaagtgactgaagagatcgaatacttatcagcgattgaagaaggtgcttacgttatcgcacaggcgaactcaaacttagatgagaacttccgctttaccgatacttatgtgacctgtcgtggtgaacacggtgagtccggtttatatcgcccggaagaaattcactatatggacgtttcaacgcaacaagtggtttctgtggcggcagcattaattccattccttgaacacgacgatgcgaaccgtgcgttaatgggtgcaaacatgcaacgtcaagcagttccaacattgcgtgcggacaaaccattagtcggtacaggtatggaaaaaccaatcgcccttgactctggtgttgcggtgattgcaaaacgtggtggtactatccagtacgttgatgcttctcgtatcgtagtaaaagtcaatgaagatgaaaccgttgcaggtgaagcaggtattgatatttataacttaatcaaatatacccgatcaaaccaaaacacttgtatcaaccaaattccttgtgtgaaattaggtgagccggttggtcgtggtgaaattcttgcagacggtccttcaacagatttaggtgagttggcgttaggtcaaaatatccgtgtggcatttatgccttggaacggctataacttcgaagactcaatgttagtctctgagcgtgtagtacaagaagaccgctttactacaatccacattcaagagttatcttgtgtggctcgtgataccaaacttggtgcagaagagatcacggcagatattccaaacgtgggtgagtcagcattaagcaaactggacgaatcaggtatcgtgtatatcggtgctgaagtgaaaggtggcgatattcttgtgggtaaagtgacaccaaaaggtgaaacccaattaatcccggaagaaaaattactccgtgcgatcttcggtgaaaaagcatcagatgttaaagatagttcgcttcgtgtaccaaacggcacatcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccgttatcgacgttcaagtctttacccgtgatggcgtagaaaaagacaaacgtgcgaaagacattgaagaaattcaattacgtgaagcgaaaaaagacttaaccgaagagttagaaattttagaagctggtttattcactcgtgttcgcaacttattagtagaaggtggcgtaagcgaagcagaattagataaagtggctcgtgagaaatggttagagcaaactttagaagatgaagcaaaacaaaatcagttagaacagcttgctgaacaacacgaagagttacgcaaagagttcgaacgtaaacttgagatcaaacgtaacaagatcattcaaggggacgatttagcaccgggcgtattaaaagtagttaaagtttaccttgcggtgaaacgtcaaatccaaccaggggataaaatggcgggtcgtcacggtaacaaaggggttatctcgaaaattaacccagttgaagatatgccgtacgatgaaaatggtcagccggttgaaatcgtgttgaacccactgggcgttccttcacgtatgaatatcggtcagatcttagaaacacacttaggtttagcggcacgtggtattggtgatcaaatcaacgcaatgattaaacaacaacaatctgttgcgaaattacgtgaatatatccaaaaagcgtatgatttaggtcatggttcacaatctgtagatttaagcactttctctgatgaagaagtgatgcgtttagcgcaaaacttacgtaaaggtttaccgcttgcaacaccagtatttgatggtgcgcacgaaagcgaaatcaaaggcttattagaattaggtggtttaccaacatcaggtcaaattaccttatatgacggacgtaccggtgagaaatttgagcgtccggtaaccgtaggttatatgtatatgctcaaattgaaccacttagttgatgacaaaatgcacgctcgttcaacaggttcttatagtcttgttacccaacaaccactcggtggtaaagcacagctcggtggtcagcgtttcggtgagatggaggtatgggcattagaagcatacggtgccgcttacaccttacaagaaatgctcacggtgaaatcggacgacgtaaacggtcgtacgaagatgtacaaaaacatcgtggacggtacacactatatggaaccgggtattccagagtcattcaacgtaatcacgaaagaaatccgtgcattagcgattgatatggaattggatgaagcgtaagaacgacaatttgtagggacgcactgcgtgcgtccgtggacacactcagtgtgtccctacattcgttcccacaagcggtcaaatcttgcaaacaatttgccaacaccgaccgcttgcaaccaaagattttcagttgaaatgggcgaccatttcaagaacaaaaacctcaaatcaggggcaaaaacgtgaaagacttagttaagtttttaaaagcacaatctaaatcgaacgacgatttcgatgtgattaaaatcggtttagcatcaccagacaaaatccgttcttggtcgtttggtgaagtcaaaaaaccagaaaccatcaactaccgtacattcaaacctgaacgtgacggtcttttctgtgcgcgtattttcgggccggtaaaagattacgaatgtctttgtggtaaatacaaacgcttaaaacaccgtggtgtgatttgtgaaaaatgtggcgttgaagtcacccaaaccaaagttcgccgtgaccgtatgggacacattgaactggcttgcccggtggcacacatttggttcttaaaatcacttccgtcccgtatcggcttaatccttgatatgccgttgcgtgatattgaacgtgtgctttattttgaaagctatgtcgtgatcgaaccgggtatgacggatttagagaaaaatcagttattaaccgaagaacagttcttagacgcagaagagcgttggggcgacgagtttgaagcgaaaatgggtgcagaaggtatccaagcgttactcaaagacttagatttagaacatcaatgtgaaatgttgcgtgaagagttacaagaaaccaactcagaaaccaaacgcaaaaaaatcactaaacacttaaaattacttgaagcattcattcaatcaggcaataaacctgaatggatggtaatgacggtattaccagttcttccaccggatcttcgtccattagttccgcttgatggcggtcgttttgcgacatctgatctgaacgatttatatcgccgtgttattaaccgtaacaaccgtttaaaacgtcttttagacttaatcgcaccggatattatcgtgcgtaacgaaaaacgtatgttacaagaatcggttgatgcgttattagataacggtcgtcgtggtcgtgcaattacgggttctaacaaacgtccattaaaatcacttgcggacatgatcaaaggtaaacaaggtcgtttccgtcaaaacttattaggtaaacgtgtagattactccggtcgttcagtaatcaccgtaggtccatacctacgcttacaccaatgtggtttaccgaaaaaaatggcgttggaattattccgtccgtttatctactctaaattagaaagccgtggcattgcttcaacgatcaaagcggcgaagaaaatggtagagcgtgaagatccgattgtatgggatattcttgctgaagttatccgtgaacacccgatcctgcttaaccgtgcaccaacacttcaccgtttgggtatccaagcgtttgaaccgttgttgattgaaggtaaagcgatccagttacacccacttgtgtgtgcggcgttcaacgcggacttcgacggtgaccaaatggcggtacacgttccattaacgcttgaagcacagttagaagcacgtgcgttaatgatgtctaccaacaacgtactttcaccggcaaacggtgatccgattatcgtaccatctcaggacgttgtattaggtctttactatatgacccgtgagaaagtaaacggtaaaggcgaaggaatgtacttccttgaccctcgtgaagcagaaaaagcataccgtacaggtcaagcggaattacactctcgtgttaaagtgcgtattactgaatatgagaaaaacgcaagcggtgagtttgaagcaacaaccagcttagtcgataccactatcggtcgtgcaatcctatggatgatttcaccaaaaggtatgccgtttaaactgttcaaccaaactttaggcaaaaaagcgatttcaaaattaatcaacgaaagctaccgccgtttaggtttgaaagaatcagttgtattcgctgaccaaattatgtacacaggttttgcatatgcggcacgttctggttcatctgttggtattgatgatatggtgattccagcacagaaatacgaaattatttcagctgctgaagaagaagttgcagaaatccaagagcagttcaactcaggtcttgtaaccgcaggtgagcgttataacaaagtgatcgatatttgggcggctgcaaacgaacgtgttgcgaaagcgatgatggaaaacttatcaacggaagaagtattaaaccgtgaaggtaatccggaaaaacaagcatcatttaacagcatctttatgatggcagactctggtgcgcgtggttctgcagcacagattcgtcagttagcaggtatgcgtggcttgatggctcgtccagacggttcgatcatcgaaaccccaattaccgcaaacttccgtgaaggcttgaacgttcttcaatactttatttcaacccacggtgcacgtaaaggtcttgcggataccgcattaaaaacagcaaactcaggttacttaacccgtcgtttagttgatgtggcacaagacttagtgatcgtagaagacgactgtggtacacacgaaggtatcgtgatgaccccacttatcgaaggtggtgacgtaaaagaagcattgcgtgatcgtgtattaggtcgtgtggtagctgaagatgtcttaaaaccaggttcagaagaagtgttaatcccacgtaacaccctaattgatgaaaaatggtgtgatgtgattgaccgtgaatctgttgatgtgatcaaagtgcgctcagtcgtaacctgtaacacagacttcggcgtgtgtgcgaaatgttacggtcgtgaccttgctcgtggtcacttaatcaaccaaggtgaagcgatcggtgttattgcggcacaatcaatcggtgaaccgggtacacagttaacgatgcgtacgttccatatcggtggtgcggcatctgcagctgcaaaagaatctagcattcaagtgaaaaatgcaggaacgatcaaacttaccaatgcgaaatcggttacaaacaaagacggcaagttagtactaacttctcgtaacaccgaattaactgtggttgatgcgttcggtcgaactaaagagaactataaagtgccttacggtgcggtgctttcaaaagcagatggtgcagaagtgaatgcaggcgaagtcgttgctaactgggatccacatacaatgccaatcatctctgaagtaagcggtttcatcaagttcagcgacattgtcgatggcttaaccgtaacacgtcaaaccgatgaactcacaggtctttcatctgtggtagtacaagatgtgggtgagcgtgcaacggcaggtaaagatttacgtccagcattaaaattagtcgatgcacaaggcaacgatattttaatcgcaggtaccgatgttgcagcacaatacttcttaccaggtaaagcaattgttaccttaaacgacggtgcagaaatctctgtgggtgaggcattagcgcgtattccacaagaatccacagcgactaaggatattacgggtggtcttccacgcgttgcagacttatttgaagctcgtaaaccgaaagagccagcaatccttgcggaaatttcaggtatcgtttcatttggtaaagaaaccaaaggaaaacgccgcttgttaattactccagcagagggcgaaacacacgaggaaatgattccgaaatggcgtcagctcaacgtgtttgaaggcgaaatggtacaacgtggtgatgtgatctctgacggtgcggaaacgccacacgacatcttacgcttacgtggcgttcacgctgtaactgaatacatcgtaaacgaagtgcaagaagtttaccgcttacaaggggtaaaaattaacgacaagcacatcgaagtgatcgtacgtcaaatgttacgtaaagcggtaattaccaacgcttacgactctgaattcttagagggcgagcaagtggaagttgcacgcgtgaaaatcgctaaccgcaaacgtgttgctgaaggcaaaccggaagtggaatttgaacgtgaattgcttggtatcaccaaagcatcacttgcaacagagtcattcatctctgcagcatcgttccaagaaaccactcgtgtgcttaccgaagcagctgtggcaggtaaacgtgacgaattacgcggcttaaaagagaacgttatcgttggtcgtttaatcccagcgggtactggttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacgtgcaaaacgccgtagcctagatgaagaaatcagcgtagcacaagcggcagtttctgcttcttcttttgcaactgcagaagacatcgaagctgaaacccaaagctttgttaatgacgaagcaacccaaaaccttgcagcattattaaatgcagggtttgatggtgatgatgaagagtagtcacttataggtgggctttgccccaccgttgttaaaatggaaaagccctcagaactgtgaagttttgggggctttttgatgcagatagttttacattatgaagagcaatttgtattgttcaataaaagatatttttcttagaatggaaagtcaaacgtacccaaagaaagcatttacataaaaatacaggcatagtagacaaatttgtctactatgctcatagtgagaaactctctaaaggattgaagcattattgaacatttttatagtatttaagtatcctacctacataaattgcatttttccgtctttgataaaaaatgaagtggcattgtcctgtcttttcccttgtattggttttagctgttcttgggtaattgcagtaacaaaaacttgtgaaccgctttgatacagtcgatcagccagtaattcgcatttttgagtgtcaagttcagaggcaaagtcatcaattaaaaagatacattgacgatttttttgagcaataaaatactctccttgcgcaagccgtaaggcacacatcaataatttaagttgccctctagaaagtacgtcttctactggtaatccgttagctcggaagcgaaaatccgctttttgaggaccgaccatagtatatccaacggatctgtctctttcaaagccttgtgctaaaagatcggcgtaatctctctctttttcccacccttgatagaaagttgctgtaatttctaattcaggtaaaaagaattggcagtttttttcaatgtaggtaagaatagattcggcatagacagccctagattggctaactatttgtgcaaatttgctaagctcgacatcccatggctttagttcattataatgacgagtttgtacaagggctgcatttcgttgttttagtagtcgttttaggctattccaattatgatagaagtcagtattttgatggaacaacccccaatctaggaatgctctgcgatatattggtcctccattgagcaatgttaaaccttcaggggtaataacctgcattggaagaagataggctaggtcagcgatctttttattactttccccattgattcttaatatagtttctccttgacgatttttttgtaaaccgacagagcattcgtgtttttcttcttggattttgccaaataaagtgaattcttcttggttgtacttaatgattcgattactaatatgacttttaaaggatttaccgtgaccaaggtagaaaattgcttcaagtaggctggtttttccacttccatttgctccaataaaaaagttaaagccgtggttcagctcaagatccacagctgttaaatttcggaaattattaataattaaacgagatagggacatgcaaagattacttttaaatcacataataatctatgtattagtttattgagttagtaatggataatcccaccaaatatcaaacaaattactcacttcgatttcaactaagccattagcttctaaccatttttgcactaattgacggtgagattcatcacatttacctaatttttctaagcaaattaaaccttcccaatgcaaatagccgctgccttcataagctaagccatttgggcgaattacttcatcaatgaaacgatcaacagttgtatcaatttggtcaataccagtaccttctacaaattggaatttcactaaaaagcctaattcttggaactctgctaagtgcatttttttacgctgtctgcgattacgaattggttgagccattttctttctcctatttgagtaacattatttcttaataaaatataaatcccacacaccgtgtcctaacttatgtccacgttcttcaaacttagttaaaggacggaaatcagggcgagggataaaatcgttggtttctgatgtattttgcaatgaagcatcaaattgacgtaatacttctagcatatgctcggcgtagttttcccagtctgtcgcaaaatggataaaaccattcggcgacagtttggttaatacacgggtaacaaattcaggttgaacaatacggcgtttatggtgtttcgctttttgccacggatcagggaaataaagctgcaatccacctaatgatccatcagcaatactatctcgcaaaatctctgtcgcatcgtggcagatcactcgcagatttttcacgcctttttccaacgcataagcgatacaagcaccaacccctggtgtgtggacttcaatcccaatatagttgcgatcaggattttgttctgccatttccacgagtgaacgccccataccgaagccaatttcaagcactacaggattgccgttgccaaaaattgcctcaaaatcaaaaggcgtattttgataatccaaaccgagattttcccagttattattcatcatatcacgctgataatcgctcaaacgccccgtacgcagtacaaaactacgcactttacgaagatagcgaccatcagcagtaaattcagcacgttcaacggttttacgttttttatcggcaaaagtaattttttcagacattttaatgttcgccgattaaaatctaacaagggcagaaccccaagtccaaccgccaccaaaggcttcaagaagcaatagttgcccacgtttaatacgcccgtcacgcaccgcttcatctaaggctacgggaatggttgcagcactggtgttgccataacgatctaaggtgatcacaacctgttccatatccatctctaattttttcgctgttgcactaataatgcgtaaatttgcttgatgtggtacaagccaatctaactgagctttttccaaattatttgcggttaaagtttcttctaccacatcagaaagctgcttcacggctaatttaaaggtttcgttcccttgcatttcaatatagccagattgcttatcgccacgttgagcataaggcaacactaacatctcatttttttcaggggaagcgtgtaaatgcgtagaaataataccctgttcagtacttgcttctaaaataactgcacctgcaccgtcaccaaataagatcactgtgctacgatctgtttcatctaaattacgcgagttaagatccgaaccgatcactaaggcttttttcacttgtcctgtacgaacgaactgatctgcaacacttaatgcgtaaacaaatccagtacaagcggcggctacatcaaaagcaattgcatcttcaatgcctaacaaaccttgaatttgacaggcagcacttggataagcgtgagaattactggttgttcccaccacaattaaattgatctcttgcagatcgatattggcctgttccaaacatttcttagctgcttcaaagcccattgttgcaacagtttcatcggctgcagcaatgcgacgttctttgatacctgagcgagtaacaatccactcatctgaggtttctaccattttttctaaatcagcatttgtacgaacttgggtgggcatatagcttcccgtcgctaaaattttgctgtacatatttttttctcaacttttctagattgctagatattataactataaccctctaaaaatagtaggggataggagcgattataaaggtaaatcattctcgacaatccgcaaaaaatcactaaaatcataccgcttatatcaaaaggaaattcaatgaaactcaatactcaacaacaacaagcggtagaatatgtcaatggggcttgccttgtgctggcgggtgctggttcgggcaagacacgggtgatcatcaataaaattgctcatctgattgcccgttgcggttattcgccgaagcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgataattttccttaggaaaggaaaatatgagataaattactgcttctcttgggcaaagcgtgcaatttcacgcatttgttccattgtttcagtacgagccaaaataccgtgttcgcccataattttagcgaaaacacctggtacggtttgaacactgataatgttacccgcatatttttgacatacttcatcaatggtgtgtttgtagtttttattcgctttacgcgcaatataaaccacattccaagggtgtgtaatatttgagtagaatttgttctctttaacgatattcgcatactctctgaatacgtcaaaatcgtttgcatagttccacatatcaatggttaaaccacctggtggacgacagttgatttcaagtggcattaattcgccagttttcttcacacggaaatattcaaagtggaagaaacgttcacgaactttgaatgcgtccacacatttctgtccgagtttaactaaatcttctttgatttcgcgtggaatgtagtagaacatatcgttatctttttcgaccgtttctaataccacttcagaatactcaaggcttgagtagaacacgatattgccgtctttatcggttaaaccgtcaaaagtcacgatatcgccttcgataaactcttccataatgtattcaacgtgagcatttttatagccgaagaaagcttctaattcgtctgcagatttgattttgtaggtatcgctcgccccaacacctgagtttggtttgataatcacagggaatttgagttctttagctaatttgcgtgcatcttcatcgtctttaaacacacgacctttcgccacttttaagccagctttgcggaacacttctttcatctgagctttggttttgattgccaacatatcttcgtttttatagccaggtacgttgaaatcagtacgcaattttgcgtctaactcaagccagtattcgttgtgcgactcaacacgatcaatgcgaccgtatttgtgagcaaaatagccaaccgcacggtaaacttgttcgtagtcttccatattatcgacacgataatactcagttagtgagttgcgtaagccttcgcttaattgctcgtaaggtgtgtctgcaattcccaaagtattaaacccactttcacgcaatctcaccgcaaaggtttcaaaattggttggaaagtgaggggaaatcatcacaaagtttattggtttggacatagttcttactctaaatttgaacaaattataataagaatgtgtaagcggtgagattctaatcgaaatttggaaatattgatagaataaatggcatttctatattggaattaatataaaaatgcctttaaaaatgttttaaatataaatttgctttaaaagcaaacccatgttatggaagcagttatttcaaacttcccaccatatcttcagggcgtacccactcatcaaattgttcagcggtcactaaacctaagttgatcgcttcttctttgagtgttgtaccatttttgtgtgcagttttcgcaattttcgctgcattttcataaccgatatgggtatttaatgcagtcacaagcattagagattgatctaattgctgtttaatgcgtggatagttcggttcaataccgattgcacagtgttcatcgaatgatacgcacgcatcgcctaataattgtgcagattgtaagaagttgtacgccattaccggtttatacacgtttaattggaagtgaccttgtgtaccagcaaatgaaattgttacatcgttacctaacacttgcgcacaaaccattgtcatcgcttcacattgggttgggtttactttacccggcataattgatgaacctggttcattttcagggattaagatttcgccgatacctgaacgtgggccagatgctaataaacgcacgtcgttagcgattttgtaaagtgaaaccgctaattgttttaatgcaccgtgagtttccacaatcgcatcgtgtgttgcgagtgcttcgaatttgttttgtgcggttacgaacggtaaaccagtgaatttcgcaatgtagtctgcgactttcacatcgtagccttttggtgtatttaagcctgtacctaccgctgtaccacctaatgctaattctgctaagtgcggtaacgtattttctaacgctttgataccaaaagctaattgtgctgcataagcagagaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgttaatggtgttgcgtccattaagtgagtacgaccgattttcaccacatcttggaatgctgctgctttgtcagctaaagttttttgtaaacgttttacacaaggaagggtatgttcaaccacttttttgtatgccgcaatgtgcatcgctgttgggtaagtgtcgtttgaagattgtgatttattcacatcatcatttgggtgaataatcgatttctcgccaagtttaccaccgtttaaaacgtgcgcacggtttgaaaccacttcattcacgttcatattagattgtgtacctgaacctgtttgccagattaccaatgggaattgatcatctaatttattcgctaaaatttcatcgcaggcttgagcgattaaatcacgtttttcagcagaaagtacgcctaaatcgtggtttgcgtaagcggctgcttttttcaaataaccgaatgcttcaatgatttctttcggcattgatgcttcaggtccaattttgaagttattgcgtgaacgctcagtttgtgcagcccaatatttgtcagctggtacttgcacttcgcccatggtgtctttttcaatacggaatgtcattgttttctcctagtggaataaaataataaaatcaatgagtaaatcctagcattctaggaaaaagaaaggaatggaaattgctccattccttgtccgtttttttagtttttgtgatatggatcataaatccaatatggaattatattttatctagtattaaatcgctttcggagtccggcagcatacaaggcattatctgcatcattgagtaaattctgctttgttttgtctgaaatcgtatagatatattgtcgatttattgctccatgaagtcgaaataataaagcttgatcagcatcaacacctattttaaggaggttgacgaaaatatcaatctcgcccctatctactaaatcatcaatagagtagacacctagtttttttaatgtcctttcgagttgtattgtcatattcggcagcgtccgaatacattttttcttttccatatactgattttgtttcgtatggagaatatctttcacactttcgacgacccaatgtgaaacttgttgtaagtcattaagtagatcgggagggattaaatagaaggattttagattaatgccagtctgagagtcgagaagaagagataaatttttagctatgttttcctctaagcaatgatttggtatgtgtagatagaatttatcatctttgtataaagcaaacatagctttatctttcattattccataataggaaaaataggtttttgctttcgtttcgccaatgattgggtaaagaagattacggatatgttgtgtttttgcatcaatgtatttcatatacacctcaattaattatacatcttgattaggaaatgagcgttatttacactcaaataagataatcgcttttcagccaaataatgcaatgaaataacaagaatatttttgtgacactcgtcgaaaaatcagaaaaaaaaccaatatttagaataaaaaaacacctatttgtttgaattttgagcttttcgtgtttgtaaatttatggttatttaaggctgttgggcaaatttcacttgcaaaagataaaagagttaggtagaatctcgccacttttgacattgtagtctaagtcgcttggtgtaatcatttatcaagtggtattaccgataaggtagtacgtaacaatgtttccgatttggaaactataacaaggtatgactgtgccccccttaatttaatttgttaagcggtggttcagttttttattagctaaattttaatggagctctggtctaatgcagaaccaaagaatccgtatccgcttaaaagcatttgatcatcgtttaattgatcaatctactgcggagatcgtagaaacagctaaacgtactggtgcacaagttcgtggtccgattcctttaccaactcgtaaagaacgtttcaccgtgttgatttctccacacgtaaacaaagacgcgcgtgaccaatacgaaattcgtacacacaaacgtttagtagatatcgtagagccaacagaaaaaactgttgatgcattaatgcgtttagatttggctgccggcgttgacgtgcagatcagcctaggttaattaagaggttattacaatgattggtttagtcggtcgtaaagttggtatgacccgtatcttcaatgaagacggagtgtcagttccagttaccgttatcgaaatcgaagccaaccgtgtgactcaagttaaaactcttgaaaacgatggctatactgcagttcaagttactactggctctaaaaaagcaagtcgtgtaactaagcctgaagcaggtcatttcgttaaagcaggtgttgaagctggtcgcggtttatgggaatttcgtactgaaggtgaagaattcactttaggtcaagaaatcaacgtagacatcttcacagatgttaaaaaagtagatgttactggtacatcaaaaggtaaaggtttccaaggtggtgttaaacgttggaacttccgtactcaagatgctactcacggtaactctttatcacaccgtgtacttggttctattggtcaaaaccaaactccaggtcgtgtgtttaaaggtaaaaaaatggctggacacttaggtgctgagcgtgtaaccgttcaatcacttgaagttgttcgtgtagatgctgagcgtaaattattattagttaaaggttctgtacctggtgcaactaatagtgatgttattgttaaaccagcagttaaagcataagtctaggagatagagatggaattacaagttgtaggtgcgacagcactcagcgtttctgaaactaccttcggacgtgagtttaatgaagcgttaatccaccaagtagttgttgcttatgcagcaggtgctcgtcaaggtacacgcgcacaaaaaactcgtgctgaagtgtctggttcaggcaaaaaaccttggcgtcaaaaaggtacaggtcgcgctcgttcaggtgatatcaaatcaccaatctggcgttcaggtggtgtaactttcgcagcgaaaccacaagatcacagccaaaaagtgaacaagaaaatgtaccgtggtgcaattaaaagcattctttctgaattagttcgtcaagaccgtttagtggttgttgataaattcgaaatcgatgcaccaaaaaccaaagttttagtacaaaaattaaaagatatggcgttaactgacgctcttatcatcactgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttatcatcactgcaagcttagatgaaaacctattcttagcagcacgtaacttatacaaagttgatgtacgtgatgtacaaggtatcgatccagtaagcttaatcgctttcgataaagtggttatcactgttgatgcagtaaaacaaattgaggagatgttagcatgattcaacaagaacgtttgctaaaagtgcttaaagcaccacatatctctgagaaagcgacaaataacgcagaaaaagacaacacaatcgtattcaaagtagcattagacgctaacaaagtggaaattgcgaacgcggttgagcaacttttcgaagttaaagtagattctgttcgtacagtggttgttaaaggtaaaactaaacgtcacggtgcaaaatcaggtcgtcgtagtgactggaaaaaagcttatgtaactcttcaagaaggtcaatcacttgacttcgttgaaggtgcggcagagtaatttcggaggaatagaaaactatggctatcgttaaatgtaagccgacctccgctggtcgtcgtcatgtagttaaagttgttaatactgagcttcacaaaggtaaaccttttgcagcgcttttagatactaaatctaaaacgggtggtcgtaacaacttaggtcgtatcactactcgtcacatcggtggcggacacaaacaacactaccgtttaattgacttcaaacgtaacaaattagacattccagctgttgttgagcgtttagaatacgatccaaaccgttctgcgaatatcgcattagtactttataaagatggtgaacgccgttatatcttagcaccaaaaggcttagctgcaggtgatacgattcaagcgggtgcttcagcgccaattaaagtcggtaactcattaccaatgcgtaatatcccagtaggttctactgttcataacgtagaattaaaaccaggtaaaggcggtcaaatcgctcgttctgctggtgcatatgtgcaaattatcgcgcgtgaaggtaactatgtaactttacgtcttcgttcaggcgaaatgcgtaaagtattagctgagtgttctgcaaccatcggtgaagtaggtaactcagagcatatgcttcgcgtacttggtaaagcaggtgcaaaccgttggagaggtattcgtccaaccgttcgtggtactgcgatgaacccagtagaccacccacacggtggtggtgaaggtcgtaacttcggtaaacaccctgttacaccttggggcgttcaaaccaaaggtaagaaaactcgtcacaacaaacgtactgataaattcatcgtacgtcgtcgtggcaaataattttttaattaattaaagaggataagccatgccacgttctctcaagaagggtcctttccttgacctacacttgttgaagaaggtagagaaggcggtggaaagcggggataaaaaaccaatcaaaacttggtcccgtcgttcaatgatcattccatcaatgatcggattgaccatcgcagtccataatggtcgtcagcatgttccagtttatgtttctgatgaaatgatcggtcataaattaggtgaatttgcaccgactcgtacataccgcggtcacgccgcagataagaaagctaagaaataagaggtaaaagatggaaactattgcaaaacatcgttacgctcgtacttctgcacaaaaagctcgcttagttgctgatttaatccgtggtaagaaagtttctgcagcattagaaatcttaactttcactaacaaaaaagcagcagctttagtgaagaaagttttagagtcagctatcgcaaacgcagagcacaatgacggtgcagatgtcgatgatcttaaagttgcgaagattttcgttgatgaaggtccaagcatgaaacgtgttatgccacgtgctaaaggtcgtgcagatcgtattttaaaacgtactagccacatcactgtggtagtgtcagatcgttaatcagtaggagaatagcaatgggtcagaaagtacatccacatggtattcgccttggtattgttaagccttggagctctacttggttcgcgaatacacaagatttcgctgataatttagaaggcgatttcaaagtacgtcaatttttaaacaaagagttagcgaacgcgtctgtatctcgtattactatcgagcgtccagcaaaaagcattcgtgtaactattcacacagctcgcccaggtatcgttatcggtaaaaaaggcgaagatgttgaaaaattaagaaacgcagtatctaaaattgctggcgttcctgcacaaatcaacatttctgaagtgaaaaaaccagagctagatgcaaaattagttgcagatagcattgctgctcaacttgagcgtcgtgtaatgttccgtcgtgcaatgaaacgtgcggtacaaaacgcaatgcgtttaggtgctaaaggtatcaaagttgaagtaagcggtcgtttaggtggtgcagaaatcgcacgttcagaatggtatcgtgaaggtcgtgtgcctctacatactcttcgtgctgacatcgactataacacagctgaagctcacacaacttacggcgtaatcggcgttaaagtgtggatcttcaaaggtgaaattcttggtggaatggctgcagtgattgaatctgagaaagaaccagcggcacagcctaaaaagccagctcgcaaaggtcgtaaataaggagatcactgaatgttacaaccaaaacgtacaaaattccgtaaagtacacaaaggccgtaaccgtggtatcgcgggcggtacagaagtgagcttcggttcattcggcttaaaagcaattggtcgtggtcgtttaacagctcgtcaaatcgaagcagcgcgtcgtgcgatgagccgtgcagtaaaacgtcaaggtaaaatctggatccgtgtgttcccagacaaaccaattactgaaaaaccattagaagtccgtatgggtaaaggtaaaggtaacgtagagtactgggtagccttaatccagccgggtaaagttctctatgaaatggatggtgtatctgaagaagttgcacgcaatgcattcgcattagcagcagctaaacttccgttcaaaaccacatttgtaactaagacggtgatgtaatgaaagctcaagaactacgtaacaaaagtgttgaagagctgaatggtgaattagtgaaccttttaggtgaacagttcaaattgcgtatgcaagcagccaccggtcagcttcaacaaacccaccagttaaaacaagtgcgtcgtagcattgcacaagttaaaactgtattaaccgaaaaggcgggtgagtaatgactgataaaattcgtacagtacaaggtaaagttgttagcgacaaaatggacaaatcatttgtagttgctatcgaacgcacagttaaacacccaatttatggtaagtttatccgtcgtacaacaaaattacacgtacacgatgaaaacaacgaagctaaattaggcgatgtagttgaagttaaagagtgtcgtccactctctaaaactaaatctcatactttagttcgtgttgttgaaaaagcagtagcttaatcaacaataaaaattaagacccctagcagaaatgctggggtttttgtttttttcacgattgctaaatgtatcttttctttacatttatgtgttttccttaataaagtaaacttgtagcaaagctacatatttttatattaatatagagaattatttcaaaaatgttaactatatcacagatttttagtgtatttagtagtttaatgcgtttgtgaaaatatggagggggtacagctaattttcatatattgctatgttgtttttttgctgtatccgtaaattttaattatttaaagcaaagacgaaaaaatgaaaagaagattatctaaaaatgttaaatgcagttttgtaccttcattgatttttctagcattagcatctaatttgcatgctactacgttctggaaaagcgatttaaacgagaatctaactcatataactaaacgagtaggtcaggataattttacggtagctgaagaaggacgattatggcctggtataggtcctaatggagaggctcctggtacagtgcctctatattatagccgtattccagcaatgaccattacagatgataataaaatggttgttatgtatgatttaagatggaacagcgcatccgatcaagatagaatcgatccaggagtatccatttcagaagatggaggaaatacttggttaagtaaaacagcttggacatttaatgattctaaaatgcctttgcgaagagctatggatcctacgattttgtataacagtatagatggtagtatctatgctatgcatgggacttgggctacaggtaatggattttggtatcaagatcgtttcaactattttcaaaataatatttgggctacaaccatttataagtctatagatggagggaaaacttgggagaaaaatgctgaatttagtaaattaagtaaccccgatgttttttctaaagtaagtaaaggtccaaataacccagtagttagttttttaggaggtgttggttctggtattgtgatgcgtaatggaacattagtatttccaatacaaactgctcataattatggtattgcagcaaccattatgtattctaaagataatggaaaaacttgggaaatgccagaaacaacggatcttccagcaccgaatcaaagctctttagagaatatggtttttgagatggggaataaattaattatggttggaagggaggcgagagtaagaggaactcaagcagataaacgatgggcatactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacagaagatatgggtaagagttggcatgcttatgaacctgcgagttttggttctagtacagcccaaccaagtcaaggctcatcaatttatgttaccttgccaaacggtaggagagtattgctcgtttcaaaacctaatggtaataatgataactgggctaggggtaaccttgctctttatatgctagatgcaaaagatccacaacatgtatatgaggtggctattatcagacctggttctggaaataaagcgggtgcaggttattcatctttggcttataaagagggaaatttatttgttgcttatgaggatgatggaaatattactgtaaaaaatttgacacaatatatgacagatattcaagctaaagcccttgaatggaatcttcctgatgaaattgaacctgatgttgaaaaaattaatgctttaatgcatttgaatcaggggcaaaaagacgaattgattgctaaacttcgtagggcaaatgataatgcaatagcacagtctattacgcttgatcaggctatgtcagaattaaaactcaaaagctttgcattaagtcaacaagcggtttcttttgaaaaggctttaccatccaatcttaagaatttccaagatgcattagcatctattaatactatttcagaatctaagaatacaacaaatgtcaattatttaggtgttcatgatttatatgatagcttgtataccatgtttttagctttgaataatccattggactttaccaaatatattgagcaggctaagcatttaaatgaatacaatcatgatattttgtatcgctcctttgatggtgtttttgctcattatagtggaggttcaaaatataataagctctctttaggtggaaataagacggttagtgaaaaagttcaggctggattgttttttgaatatggcaataaacatcaaaaaagttatcacgttggtatgagagcaaaatatcaactggataatcatcagattgctggttttattcgttaccgtggcgtaaaacaccaagactttattgaacgtaataacaatgttgatctttatttgaactatgcttatcaacttagattgagtgaagatctgagtgtgagtccttcgtttggtgcctatatttctcgttccaatagaacattgttagatcaggatgtcgctgttaataagagaacagtttatgctggagatgttggtgtgaatcttatgtataagataaatgatattaatgtaaatatccgaccaaatattgcattcatcaatgacagtctgaaactatctcaatctaatgataagagtaatgtgtataaaattagttcacataatacaatttatggattggcaactagtattaataaagctttttcaaatggattgaaagtaggttcaacattagaattgcaaaaatatggtagtcaatattctaatgtaaatttaggtgtagatatcagttatacttggtaactagacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcattaccaaaagcgtaaacggtaatcctactttcacaaaatccataaaactatagccacttggtgcaagtaccatcgtattcacaggagatgaaacgggggtaataaaagaggctgaggctgaaatagcgacaatcattgcaaatggtactggcgaaaaatttagctgttgtgcgatagcaatggcaatcggcattactaaaattgcagtggctgtatttgagataaaggcattgatgatggcggtaaaaataaataacaccatcaacacaaaatgcacccctaagccttgcataatctcagtgagcatttgaacaatcagatcgatcccgcctgttttttgtaatgcaatggaaaatggcatcataccgacaattaaaacaatactcggccaatggattgattcgtaagcacttttcatatcaacacaacggaatttgcccaacatcaaacaggcaatcaaagccgcaatcacattcggcactaaccctgtaatcatcaacaccaccattgtgacaatcgaaaaaattgcgtgaggtgcttggctaatcgctggtgctgcgtgtttgctctcttcgggagctttgagtaggaagaagtcacggttattgtgatcgagtttgagcaaattattccatacccccataatcagcaaggtatcaccaaattctaacggggttgaaatcagattatcttcaatcaatgtatccccacgttttaacccgacgacacttaagccataggtagaacgcaatttaagttcactaatactttttccgatacttcctgcttcaggcataatcgaaaattccgccattccaacagattttgcgtgttctgagaaatagtcccctttcaactcaattatgcgtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcttttccttgcaaagtttccgtaccataggcggcaatagaaagcgttcttaaacgtttaacacgttgaatagcaacgatatttagcccatactcgcggcggagatttaattcattgatcgtttttccaatcaatgatgaaccagcatcgatcaccaccatttttgcccgcccagttaaattatattccgcaataagctgttgcattgatgaaccatttttattttcagtgcggactgtttcgccattatctaaccaacggcgagcaaaaagcatataaacaatccccagcaccaagaccgaaacgccaatcggtgtaaaactgaagaaaccaaaaccttgatgtcctgctttaactaattcagagttagccacaagattgggcggtgtcgcaattaaggtcatcataccgctaataagcccagcaaaactcagcggcatcattaagcgtttcggagaaatccccatacccgaacaaattgccaacaccacaggaataaaaatagccacaatccccgttgaactcataaaagagccaagtccagcaatagataacatcaacaacactaaaaccttaacttcgcttgcccctgcaacacgcattagccactcactcacctgataggcaatccctgttcttacaagcccctcgcccacaataaagagcaaagcaatcaaaatcacattcggatcacttaatccagcaaacacttcattgaccgaaagaatgccacttagactaaaaaaggcaataacgagtaaggcaacaatatccattcgtaatttattgcgaatgaactgccaaattgcaaataccaataaggcaaacacccaaaacagtggcgataagagaaaatcagggagggaataaagtatcggttgcataagcattatcaaggaagttgaacaacagtttgattataccgattttcagaaaattaacagggagttttctcaaattccgctaaaaaatttggcatatctctattaggtgctctcgctagaatttaattggttatattgaagtgttcacaagagccctttgggcttttaccaacaaaattattaactttttcttaatagcatatgaaaatacattatgtcgcaaataatatcagggatatttatttctaaaagcataagaatgttaatttttttataaaaatgttaagtaaccgaaatttttgcagggtttacaggttggcaattttggtcaatctgcgtataattcggaagattttgattgcgtaactttagattagtttacacaaagaaatcgtttacttttttattaggttttagttaaaaatgtctgcggttcttcgacaaacgaaacaactttatcaaaaagcactcggtatcgagttaattctgctgttctgcatagcaggagcagtggggattgggttgggcttaaatcgctttatttcgttattattaggggaaattgcggcgttgcttccgcattgtgtgtttgtgtattgggtgttttttcgtcagtcggtaataaatccccaaaatatgaccgctttttatcgtggggaagggctgaaatggcttacgacgattgttgtgattgtagtggcatttaaaagttatggtgctatgcactatgtttcgtttttttgtgggttcttttttattattctttgtaatagtcttttgcctattgcattgaaatggcattcaaaataaatttcttttaatttcaaagggataagctatggctggtcaaacaacggctgactatattggtcaccacttatcgttcttaaaaacaggggacggtttttggaatgtgcatttagatactctgtttttctcattagtagcaggtgcaactttcctctttttcttctctcgtgtggcgaagaatgcaacagatggcgtaccaggtaaatttcaatgttttgttgaaatgattgtcgagtgggttgatggtttggttaaagataacttccacggtagtcgtgaggttgttgctcctttagctttaactgtgttctgctgggtgttcgtaatgaatgctatcgacttaattcctgtggattatccaccacaatttgctgcattattagggattgactatttgcgtgctgttccaacagcagacattagtgcaaccttaggtatggcgatctgtgtattctgtttaattattttttacaccattaaatcgaaaggtttttctggttttgttaaagaatatacgcttcacccatttaaccactgggcatttattcctgtaaactttgtacttgagatcgtaacgttattggcgaaaccgatttctcttgcattccgtttattcggtaatatgtatgcaggtgagttaatttttatcctgattgcagtgatgtatatggcggataacttcttgcttcaagcattaggtttgccattacacttagcttgggcgattttccatattttggttattacgttacaagcctttatctttatgatgctaacgattgtttacttgagtattgcttataataaagcggatcactaaacaaactggattggtgagcggttacttttatgcaaaaaattgcaatgattagaccgcttatgaaacccgatcatatttattgaaacttttttattaaccctagccataaggctaatttccttacttttatggagaacattatggaaactgtaattacagcaactattattggcgcatcaatcctacttgctttcgcagcattaggtactgcaattggcttcgctatcttaggtggtaaattcttagagtcttcagctcgtcaaccagaattagcaagcagcttacaaactaaaatgtttatcgttgcaggtcttttagatgcgattgtaatgattgcagtaggtatttctttacttttcatcttcgcaaacccgttcattgatttattgaaataagtcggatttgtttttaaccgtagttactcaagagtaacttagccgacttaaggagggcgttgtgaacttaaatgcaacactaataggccaactgattgcattcgcactatttgtgtggttctgtatgaagtttgtatggccaccgcttattaaagcgattgaaacgcgtcaagcaaatattgcagacgctcttgcaagtgctgagaaagcgaagcaagaacaagctgatactaaagttttagttgagcaagaactcgctaaagctcgtgaagaagcgcaacatatcattgatttagcaacaaaacgtcgcaatgaaattttagaatctgttcaagcagaagctgaagcagagaaagcgaaaattattgagcaaggttacgcagaagtggaaaacgagcgtcgtcgtgttcaagaagaacttcgtcaaaaagtggctgcattggcggttgctggtgcagagaaaattgtgggtcgttctgttgatgcagcggcaaacaatgacatcattgataagctagttgcagaattataattaaggggggcagatgtcacaattaacaacagtagctcgcccctatgctaaagcagcttttgattttgctttagaacaaggtcagttagataaatggcaggaaatgttacagttttctgcattggttgctgaaaatgaagatgtgcaacattttattcattcatcttctgcagccactcaagttgccgatacctttatcgcaatttgtggtgatcaactcgatcaatatgggcaaaatttcattcgagtcatggctgagaataagcgtctttcggcgttaccttcagtatttgctagttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcaggcgttattattcgttacgatgatattgtcattgatggtagtagtcgtggtcagttaaatcgtttgagccaagagttgtgcttgtaagaggaatagaaaatgcaactaaattctacagaaattagtgaattgattaaaaaacgtattgcacagttcaatgtggtcagtgaagcacaaagtactggtacaatcgtttcagtcagcgacggggttattcgtatccacggtctcgctgatgtaatgcaaggtgagatgattgcattaccaggcaatcgttatgcgattgctttaaacttagaaagagattcagttggtgcagtagtaatgggtccatacgcagatttagcagagggtatggaagtgaaatgtactggccgtattttagaagtccctgttggtcgtggtttattaggtcgtgtagtaaacacattaggtcagccaatcgatggtaaaggtgaaatcgataatgacggtttctcgccaatcgaagtgattgcaccgggcgttatcgaccgccaatctgttgatcaaccagttcagactggctataaagccgttgactcaatggtgccaatcggtcgtggtcagcgtgagttaatcatcggtgaccgtcaaacaggtaaaacagcattagcgattgatgcgatcattaaccaacgtgattcaggtattaaatgtatctatgtggctatcggtcaaaaagcgtctaccatttctaacgtagtacgtaaattagaagaacacggtgcgttacaaaatactatcgtggtggtagcaagtgcatcagaatctgcagcattacaatatttagcaccttatgcaggttgtgcaatgggtgaatacttccgtgatcgtggtgaagatgcgttaatcgtttacgatgatttatctaagcaagcagttgcttaccgtcaaatttcattgttattacgtcgtccaccaggtcgtgaagcctatccaggtgatgtattctacctacactctcgtttacttgagcgtgctgctcgtgtaaatgcagattatgtagaacgtttcaccaatggtgcagtaaaaggtcaaacaggttctttaactgcattaccaattattgaaacccaagcaggtgacgtttcagcattcgttccaacaaacgtaatttcgattaccgatggtcagatcttcttagaaaccagcttctttaacgcaggtattcgtccagcggtgaacccaggtatttcggtatctcgtgttggtggttctgcacaaactaaacttgttaagaaattagcgggtggtatccgtactgcacttgctcagtaccgtgaattagcagcctttgctcagtttgcttcagatcttgatgatgcaacacgtaagcaactttcacacggtcaaaaagtaacagagttacttaaacagaaacaattcgaaccaatgtctgtggcacaattaggtttatcacttgcagcagctgaatttggttatttagatgatgttgaagttgagcgtgtaggttcatttgaatcaaatcttttagcttatgcaaatgcaaattatgctgagtttatgaaagatttaagtaaatcaggcgatttcaatgacactatcaaagcgaaattaatcgagattttagatagtttcaaaaagaatagtgcttggtaatctactttagcggagaaagaatatggcaggtgctaaagagataagaaccaaaattgcaagtgttcgtaatacacaaaaaattaccaaagcgatggagatggttgctgcatctaaaatgcgtaaaacgcaagaaagaatgtctgcatcacgtccatactcagatgccattcgtaaggtaattagccatattgccaaaggaagtattgattataaacatcctttcttaaccgaacgtgaagtcaaaaaagttggatttattgttgtttcaacggaccgtggtctatgcggtggcttaaacattaatttatttaaaaccgttttaaatgagttaaaaacacgtaaagataaaggggtggattcagtcttaggattggttggaaacaaagcagtttcatttttccaatcaatgggggtggaaatcaaagctcaagtaacgggcttaggtgatacacctgcaatggaagatttagttggtattgtaaatggtatgattgaaaactaccgtaatggcgaagttgatgaagtctatattatttataaccgcttcgtgaatacgatgtcgcaaaaaccaacggttcaaaaattacttccattgccagaacttgaagatgacgatttggaaaataaaggttcgtgggattatatctatgagcctaatccaaaagtgttgctagatagcttacttgttcgctatttagaatctcaagtttatcaagcgatcgtagataatcttgcatctgaacaggcagctcgaatggtagcaatgaaagcagcaacggataacgcaggtaatttaatcaatgagttacagttggtgtataacaaagctcgtcaagcaagtattacgaatgaattaaatgaaattgtcgcgggtgccgcagcaatttaacaatgaatagaggaacggtaatggcaacgggaaaaattgtacaaatcatcggtgcggtaatcgatgttgagtttccacaagatgcagtaccaaaagtttatgatgcattaaaagttgaaacaggtttaacccttgaagttcaacaacaattaggcggtggcgtagtacgctgtatcgctcttggtacatctgatggtttaaaacgtggcttaaaagttgaaaatacgaataaagcgattgaagtaccagtgggtacaaaaacacttggtcgtattatgaacgtattaggtgagcctattgatgaagcaggtcctatcggtgaagaagagcgttggacgattcatcgtgcagcaccaagctatgaagagcaagcaaacagcacagaacttttagaaacagggatcaaagttatcgacttgatcgctccgtttgctaaagggggtaaagttggcttattcggtggtgctggcgtaggtaaaacggtaaatatgatggagttaatccgtaacatcgcaatcgaacactctggttactcagtattcgcaggtgttggtgagcgtactcgtgaaggtaatgacttctaccacgagatgaaagactctaacgtattagataaagtatcattggtttatggtcagatgaacgagccaccaggtaaccgtttacgtgttgcgttaaccggtttaaccatggcggaaaaattccgtgatgaaggccgtgacgtgttattcttcgtcgataacatctatcgttatacccttgcaggtacagaagtatcagcgttattaggtcgtatgccatcagcggtaggttaccaaccaacacttgcggaagaaatgggtgttctacaagaacgtattacgtcaaccaaaacaggttctatcacctcggttcaagcggtttacgttcctgctgatgacttaacagacccatcaccagcaacaacctttgctcacttagactcaacggttgtattaagccgtaacatcgcatcattaggtatttaccctgcgatcgacccgcttgattcaacatcacgtcaattagacccactcgttgttggtcaagagcactatgatgttgcacgtggcgtacaaaaaacgcttcaacgttacaaagagttgaaagacatcatcgcaattcttggtatggatgagttatcagaagatgacaaattagtggttgctcgtgcacgtaaaattgaacgtttcttatcacaaccattccacgttgcagaagtgttcaacagcgtaccaggtaaatttgtaccattaaaagaaacaattcgtggtttcaaaggcattttagcaggcgaatacgaccatatcccagaacaagcgttctatatggcaggttcaattgacgaagtggttgaaagagccaacaagatgtaattgttctttgaactaaggagaacaaaatgacatcatttgaactcacagtcgttagtgcagagcgtaaaatctttgaaggtcaagtaactagtgttcgagtttcaggggtagatggggaattaggtgtctatgcaggacacaccccactattaaccgccattaaacccggcatggtcaaattcactttggaagataacaaagaagaatatatctatgtttcaggcggattccttgaagttcaaccaacggttgtgaccgtgcttgcagacgttgcaattcgtggtgaagaactcgatgaacaacgtatccttgcagcaaaacgcaaagcagaagaaacaataagcaaaacaaatgaagcggatatgaccgccaaattagctcgcgaaattgctaaactgcatgtttacgaactcactaaaacgaaattagcgaatagacgttaattttatatacagaaacgccttaatatgtttatattagggcgtttttatttctcagcaatttataaaggctcactatggcaacaatgaaagatatagctcgaattgcaggggtttcactttcgaccgtttctcacgtcgtaaacaattcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctcacgtcgtaaacaattcccgttttgtcagtgaagaaattactttaaaagtcaaaaaagttattgaggagctaaattatcgcccttctttggtagcaagaagtttgaagatcaaggaaaccaataccattggtatgattgtgacgactagcaataatcccttttttgcagaagtagttcgtcatgtggaacgttattgtgaacgccatcattatcacctgattctagttaataccgacggcaacagccaaaatttacagcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttattaaagcaagttgatggcttattgctgatgtgtgcagaacctcaaaattttgacttaagtgcgattacccatttaacactcccgatggttgtgattgactggtggcaacaacctttaaatgccgatatcattcacgaaaattcagaattaggtgggtatcttgcaacaaaagcactaatagatgctggttatcgtgatattgcggtaattacgggcgaattgagtaagccattggcagttaatcgtctggaaggatacaagcgggctttttctgaaaaccatttaccaattcgtcctgaatggattattgaaagccatttccattatgatggggggattgaagcaatgacaaaattgttagctttaccttcacgtcctaaagctgtttttgcgatgagtgacagtattgcgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagtgacagtattgcgattggtgcatatcaaatgattcaacgagcaggattacggattccgcaagatattgcgattatcggttacgataatatcgaacttgctcaatatctttatccccctctttctactattcatcaacctaaagcccgattagctaaagctgctgttgagaaattaattctacgtattcagcaaccacaaacggaaatagaaacgatcaagctaacccctgaattaatcatacgggaatctttttaaacctattttttgaagtagttcacattttcaaaataacatagttgtttttttattattttttgtctatcttttagtcatcgaaacgtttcgatggatttgtaaggatggtttgtgatgaaaaagacaacaatcttaaatgctcaactttcacatgtaattgcaacaatgggacataccgatggactcacaatttgtgatgctggtttaccaattccaacagagcagcattgcattgaccttgctttaaccaaaggtatccccgattttctttcagtcttacaagcggtatcaagtgaattatttattgaaaaaattgtattagctgaagaaatcaagaatattaatcctcaaattgaacaacagttattaatggttattcaacaaatagaggtgcaacaaaaaaataccattaagattgaatatatcccacataacgaatttaaacatcaaagtaatcaagccaaagccgtcgttagaacgggagaatgtagcccgtatgcaaatgttattctttattcgggcgtaccattttaggtggatatgatgaaaaacttactcaaaattagtggaatagataaagcctttcccggtattcaggctcttaaaaatgcttgcttgaatgtctatgcgggtagagcgatggcgttaatgggggaaaatggtgcgggtaaatccaccttaatgaaaattctcactggaatttatcaacgtgatgctggtacgattgaatatctggggcaagcagtgaaatttgctaatccgaaagcctctcaagaagctggattgagtattattcaccaagagctaaatatactcggtaatctctccattgctgaaaacatctttttaggacgtgaatttacgcacccttggggcggtattgattggcgtaaaatgtatgcggaatccgaccgcttgttagctcgccttggtgttcgtcattccagtaaacttcctgctggtgagctttctatcggtgaacgacaaatggtagagattgctaaagcgttgagttttgaatcgaaagtgattgtgatggatgaaccaacggatgcgctgacggatacggaaactgaagctctatttgcagtgattcgtgagttgaaagcggaaggtcatggtattgtctatatttcccaccgcattaaagagattttccaaatttgtgatgatgtgactgttttgcgtgatggtcaattcattggagaaaaagcggttaccgatttaactgaagatcagttgattgaaatgatggtcggacgaaaattggaagaacaatatccgcatatcgacaccgatcaaggtagtgtatgccttgagatcaataatttgacgggaggcggcgtttatcaaatctcattcaacctgagaaaaggcgaaattatcggtgtttcaggattgatgggggctgggcgaactgagttgatgaaagtactttacggggcattgcctcgtacatcgggttcagtcagattagatggcaaagacattcataaccgtaccgcccaagatggattagataatggcatcgtgtatatttccgaagaccgcaagggggatggtttagtgctaggtatgtcggtgaaggaaaatatgtctttgaccgcattagcccatctttctcattacggaagaattgataaagctagagagaatatggtcgtcacggattttattgaactgtttaatattaaaacccccaatgccgataaaattattggtgagttatctggaggaaatcagcaaaaagtagcgatagccaaaggattaatgacccgtccaaatgtgctgattttagatgaaccaacaagaggcgtagatgttggagcaaaaaaagaaatctatcaacttatcaataaatttaaagcggaagggcttagtattattttagtatcgtccgatatgccagaagttttaggcatgtccgaccgtattttagtgatgcgagaaggtcgaatcagcggtgaatttagccgtcaagaagcgacgcaagagaaattattggcggctgcaatcggtaaaacaagcggtcagatctcataggaaatttgcaaatgaataaatcgtttaacttcactaaatttttaatcgaccaacggtcgatcattgcattaatcacgatgattgtcgtggtgtcatttctaaatccggatttttttactacggataacttgctcaacattctgcgccaaacctcggtgaacgccattattgcgattgggatgacttttgtgattttgattgccggtattgatttatcggttggttcagtacttgctttgacgggagctgtggctgcaaccttagtcggtatggatttaccggtttatgccgtgattcctacggtactgatttttggcggactgatcggcttgttgaacggatcgttggtggcattcggtaaagtacaagcctttatggcaaccttgattacgatgctgttattacgtggcgtgaccatgatttatatgggtggtcgcccgattagcaccggtttttccgagaatgctgatgctttcgccgaaatcggcacaggaatttggctcggtattccggttcctgtttggctgatgtttgccttatttgcgttaggttggtttgttctgacccagacgcgtatggggcgctatatttatgccttagggggcaacgaatcggcaaccgtactttcaggcattaatgtgaataaggtgaaactctttgtatttgcggtcagtggtgtattggctgcccttgctggtttgatcgtcacctctcgtttaggctccgcccaaccaaccgcaggaacaggctatgaattagatgcgatagcggctgtcgtagtgggtggtaccagtcttatgggcggtaaaggccgtattatcggcacgttaataggtgcattaattattggtttcttgagcaatgccttgaatttattagacattgactcttactatcaactggttgcgaaagcactggtaatcttagctgcggttatcttagataacttcattggtcgtaaaaaagtctagttgttctaagacattattcttcattacataggagatttttatgaaaaaattaacttcattagggattgcattaggtttagcattcagttcatcagcaatggcaaaagaaactatcgctctggcaatttcaaccttagataatccattctttgtgaccttgaaagaaggtgcagagaaaaaagccaaagaattaggctataacttagttgtgttggattcacaaaacgatccagctaaagagttgtctaacgtcgaggatgtgactgttcgtggtgcaaaagtgttactgattaacccaaccgattctgaagcggtaggtacagccgttgcggtagccaataagaagaatattccagttatcaccttagaccgtggtgcaaataaaggtaatgttgtgagtcatatcgcctctgataacgtggcaggcggaaaaatggccggtgactttatcgctgaaaaagtcggtaaaaatgcaaaagtaattcaattagaaggcattgctggcacctctgctgcgcgtgagcgtggagaaggttttaaacaagcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaagccaaccaatttgaactacttgctagccagccagcggatttcgaccgcactaaaggtttaaatgtgatggaaaacttgcttgccagccatggttctgctaaagcagtatttgctcaaaatgatgagatggcattaggggcgttgcgtgcaattaaagcttcaggcaaaaatattttagtcgttggttttgatggtacggatgatgcggtaaaagcagttaatggcggacaacttgcggcaactattgctcaacaaccagaaaaaatcggtgagttaggtgttgaagtagcggataaagtgttgaaaggtgaaaaagttgaagcacaaattccggttccattaaaagtaatttctaaatagtttgttggtaggggcaaatgacatttgccctattttcatactagtggcgaaagatatttcgcctctatatttaggagtagttatgaaaaaactctgtgttctcggtagtatcaacgttgatcacgttattcgtgtgccttattttccaaaagcaggcgaaaccttaacaggttacggttatcaaattgcttatggtggaaaaggggcaaatcaagcggttgcagcggcaagatgtggtgcaaatgttcactttattggtgcaattggtgatgatcaaattgggaaaacaatgaagcaagcctttgaacaagacgggatcaatacagaagcaatttctgttatggaaaaccaatcaacagggttggcgatgattcaggttgccgatttgggtgaaaatagcattgtaatttccgctggcgcaaatgcggatctttccgaagcattggttgaacaacataaatcacatattgaacaagcggatattttgctaatgcagttggaaagtctgttacaagcggtggctaaggctgcaaaaattgccaaaaaagcaggggtaaaagtggtgttaaatccagccccagctcaacctttatctgacagtttattatcactaattgacatcattaccccaaatgaaacagaagcggaaatattgacaggggttaaagtgactaatgagcaaactgcagctgtagccgccaaccattttcatcaacttgggatcgaaacggtcttaattaccctaggctcaaaaggtttgttttatagcgaaaaaggacaaggtgaaattattccagggttccgtgtcgatgcagtggatacaacagccgcaggcgatacatttaacggggcttttgtgacggcattactagaaggaaagtcgcctaaagaatctattcgttttgctcacgcagcagcggcaatttcggtcacaagaatgggggcacagacagcaattcctagacgcgaggagattgaggcgctcttattattttcaatgtaacttaaactactatgttggagtttttcttaactggcagtttgtgaatgacaatgcggtttgatatttgtacttaacgagtcgagcggctacgatttgttaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgttaggtataacgttaattttatctctctattgaaatacattgacgagcatttttaatcacaatatagtgtcgatagagaacaaagttgttttgcaaacaaagatattagaaaaaataatgaaggtcataaaaatttttattgatatttctttttcttatggtattttaaacagcgtctcagacacttttttatttgtagttattattttaagaggattagccaatgtcaaacaccaactctattgcaaacgttgcaaaactcattcgagagaatgatattaaatttgtcttactgaaatttaccgacattaaaggtaaagaacacggggtatcaatgccagtttcccttgtcgcagacgacctcgaagacctttttgaagaggggcgaatgtttgacggatcctcggttgaaggttggcgagcgattaacaaagccgatatgctgttaatgccaattcctgaaaccgccgttgtagaccctttcgcccgtatcccaaccctcactatccgctgtagcatcttcgacccaaacacaatgcaaagctatgaccgtgacccacgttcaattgctattcgtgctgaaaactacctaaaatcaacaggcattgctgatagcgtaatgtttggtccagaacctgagtttttcctctttgatgatgttcgttttagcacagagatgaacaatgtgtcttatcatattgatgatattgaagcggcgtggaatactaaccgtaaatatgaagatggcaataatgcgtatcgtccactcaaaaaaggcggttactgtgcagtagcgccaatcgacaccgctcacgatattcgttctgagatgtgcttgattttagaagagatgggcttagtgattgaagctcaccatcacgaagtggcgacagcaggtcaaaatgaaattgcaagccgtttcaatagtttaactttaaaagcagatgaaacccaaatttataaatatgtggttcaaaacgttgcccttgaacacggtaaaaccgcttgctttatgccaaaaccattcgcaggcgataacggctcaggtatgcactgtaatatgtcgttaagcaaagatggcaaaaacgtctttatgggcgataaatatgcaggcttgtctgaaactgccctttactatatcggtggtatcatcaaacacgctaaagcattaaatgcgtttactaacccaacaacaaactcatacaaacgtttagtaccaggctttgaagcacctgtattattagcttattctgcaagtaaccgctctgcatctatccgtattcctgcggtaactagcccgaaagcaacgcgtgttgaagcacgtttcccagatccaatggcaaacccatacttatgttttgcggcgttattaatggctggtcttgatggtgtgattaacaaaatccacccaggcgatgcaatggataaaaacctctatgacttaccgccagaagaattaaaagagatccccgcagtatcaagttcattaggtgaagcgttagataacttggaaaaagattatgaatttttaacccaaggcggcgtgttcactaaagaatttatcgatgctttcattgcaatgaaacgtaaagaagttgagcgtttgaatatgaccccacatcctgtggaatttgagatgtattacgcttagccttaaaagttaggttcagaaaataaaatagttgctgatgaatactttaattattcttagcaactatatttttatttaaagaatcctttataaatatagtgttatgtatcttattgtttttgcgtgatgaaataatttttcttcatttgcctaaataaatgttaaaaaacgatttagtgttttacatatcaagaatgtaatcatcaatagagtttttttgaacgctattagatagtcattcccaatctttattagagtaggataaatattacatttataaagtttgatattacttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcatactagctaatctacgtcagccccaaaaatattgctctcccaaccgcgcttcacgctcgccatttaccacaatgcaaatactcggctcttggtcgccatttacagaaacttggttagcgataaagttgttacttgtcgtggtctatatcgttttcggtgttgtggcacaaaaaaacattcgcaccccaaaagggttcgcgttttacagcttgtcgctactcgcttttttaacaatggtgttgctatcgctttgcaaaataggctaagacgtacaccgaacttattaaccaactgaaataaaaggaaataaaatgaagattttttacaaaacctgttgtcacagcccctggacaaagtgcggttacagttacgccaaattctgccacttcttcggcaatggcttggctgaaagacgtgacataggcttttgttgcataataaaccgcttgtaatggaccaggtaaaaagcctgccgttgaagaaacgtttagaattttaccacagcggcgttccaccataccttttaagtaaaaatggcttaactcggttaaagtggtgatgtttacttggatcatttgttgttctttggctaaatcacgctcaaaaaagcgaccgtgtccgccaaaacctgcattattgattagaatatcaacggtaatgccctgtgcttccgtctgtgcaaaaatcgcttgtgccgcattaggttctgataaatcttgggcgataacggtggctttaataccgtatgtgttagctaagtcgtgtgctagttcggccaatttctcttttgaacgtgccaccaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttctcttttgaacgtgccaccaacaccacatcgccgccttttttggcgtgaatttttgctagttccaaaccgataccatttgatgcacctgtaatcaatgctgtttgtttcattttttatccttcattgtctttgctttcgatgaagtgtattattccgtaaaataccagtatgaaaaaggtaaaaaagggcttaataatggcaaaaataggaaatacacaagcaatccccacaccgcaatcggcacttgaaatttgtctatttagtgaatttaaccaaagcaatttgcacgctgatgaattaacacgggaaatgctcgctgagcaacatcgctttgatttttatgtttggctgtgggtaacagaaggggaatgtcagcatttgcttgatttccaaagcgttacgcaacgcacaggcgaatggttgctgatccgcccacagcaagttcaccattttcaaacaatggaaggttgggacggttggggattatcttttccagccgaatgggtttctgctgatttagcctcaatttggcaacagctgccacaaaagcaatctgtaaccgccgagcaagcccctttgctgcaactggcgttacaacagctcaaacaatatcgctactttgaatggcaagggcaaaattatcagcccttattacaaacgcagttacacaccgttctgaccttgctcaacaccctttatgctgcaaatcagccacaagaagaccaccaaaatcaacgttggcaaggtttttctcagctattggaacaacatttttgcacgcaacatcaagtccaattttatgcggaacaactcggttgcacagaaaaaaaacgctcggctcaacctgtttagcacatacggggctgcctgccaaaatggttatcaaccaacgtttgctacttgaagccaaacgcctactggtgcatacccaaaaatccgtgaaacacattgcgttacaactcggttttgaagaagctactcactttaataaattcttcaaaaaatacgaacgatgtacgccaaaaggctttcgggaaagctatttagcggaaaaataaaagagcggtggggttttcaggaaattttgcaaatacaaaacttatgaaaatcccacagctcttctacaagttctatgacaactgttttaaataatcttccaacccttgaacttccccatacaacaactggctcggcacaatatgcaaccgttgatcgttatcccacgcatagcgggcgaaatcggcgtccattttacgaccgctttggtaaaacagccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccgcaaaggggatcgaataaataataaattttcattaaaacattccacgtccgctttctgttttttctggtaccgcttggattacgtcccaatgttctacaattttgccgttttcatcgaaacggaaaatatccaccaccgcttcgcctttatctttttcattgagctggctgtgaacgtgtaatgctactaaatcgccgtccgctaatacacgtttaactgttgctcgcgaagttgggtgttctttcaaaaacggagcaaaagcatcaataaaggcttgaccaccatcggctacacttgggttgtgttgcaaatactctttgccgatatatttatccactgcgtcttgtaattgatgttggttaaacgccatttcatagaacgccaatgcattcgctttattttgctctggcgtagtttgtgccattgcaacggttgatgagaaaagtgcagttaaaagtaaaagtaattttttcattttgttttccttttgttggattatacattcagcttgattgctattgatggcgtgcattttaatgaaataaaaagagagaaaaagtgcgattttagaatataattatttccgattaagaaacaaaaaggataactatggacaaactcaccgcaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcgttccacccgcaaagttgctctaacagacacaggcgaacaagcggtgcttttttgtcaaaaaattgctaatttaaccgcagagatggaacaagaaatgatggcacagcagggtgaattacatggtttattacgtattaccagtagccaaagttttggggcatatcatttggtacaaacggtcaatcgatttttgcagttgcgcccgaaattgaatattcagttgttgctcaatgatcaacaaatggatttaataagcgaacggatcgaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggagagttttgaagggaaagcatggtagagttaaatttggttatttatttagcactcctgctttcccattacttatggtactgtttttacgtaattatcaacagtattccgaaaaataaatctttctataataatcattacaagaataataggtgatggaatttctaccatttttttcccaagcggttgaaaatatgactgtattttcgctattttcacacataatatttggggctaatctatgatctgctcccaaaaagttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaatatgggtgcttttcgattgttctaaaaagatttctcgttaaaactaaatagcgtagaatggtgtcatttatcactacatgccttgataatcatgaatccactaaattcgctacaattagctttaaaccaatctagccttattgaagcctctgcaggcacaggcaaaacctatacgatggcaaatttgtatttgcggttgattttaggtgttcggtgtccctccccattgacagttgaacaaatcttggttgtcacctttaccaaagccgcaacccaagagctacgagatcgaattagggaaaaattggtcaatgtgggaaaatggtttcgagatccctcttctaaagaggctcaagatgcgttacgagaaccattccttgcggcgctttatcaagaagttcaaccacgtttaaatgaatgcctcttacgcttaagcattgctgaacgcgaaattgatttagccagtattttcaccattgatagcttctgtcaaaagatgttgtttcagtttgcgtttagctctggcattcgttttgatattgatttattgagcaatgaagatgaattattaactcgtttgagtgaagaaacttggcgtgaactattttatccaatgggacttgcagaaactgtcgccgttgctgaagagttaaaaacgccttctgacgcattaaccgcagtgaaaggttatctctatggcgattttccagatttagcggcagaaaaccaatggctgacacaaggcatttcaagctatctcgccgattatcaagccttgttacaagaagctaaacaacattggcttgccgtgggggcggaagcggaaagcctgattgtgactgagatcaacaaaagctacaaaaaaggcgaaaagaaatcgctcagccgccgagcttatcaaatgcgttggattgaaaattggctgaaagagctgaacgaatgggctacaagcggtagccattattttccaaccaacagcctctctcgcttttgtcaggattttatcaatgaaaaagcggaagaaggggcagaaccgcttacccacactatttttgcaaaaaatcaagattatcttaccgcttaccaaacacagtttgaaggcaaatcaaaagcgattttcctctatcaattcttcagccatctacgtcaaaaacttgccgattataagcaaacccataaagagaaaagttttggcgacatgttgagctttttgctttccgctttgcaatcagagcgtggggatacgttagcccagcaaattagagccttgtatccctttgcgatgattgatgaatttcaagatacgaaccaacagcaatatgaagtgttccatcgtatctttatggatcaaaataccagcgagcaaggttttattatgattggcgatccaaaacagtcgatctataaattccgtggtgctgatattttcacctatttaaaagcgaagaacgaggttcaggaacaggcaacacttgaccgtaactggcgctctgtgcctgaagtggtggagagttgtaatcgtctatttcagtttccagaaggagataatcctccatttttatatcacggtattccctttcagcccgttaaagctaaagaggcttcagatacattagtgggtgaacaagcgaccagatgtctattaatcagcacggagtttgatgaacagcttgcggccactcactgtgcttatcaaattcaacaacagctgaaaaaaagtgagcaagggttgctctttgtgcaaaaagaggagggaaatagaccgcttgaagccaaagacattacgatccttgtgcgtagccataaacaagccagtttaatccgagcagaattattaaaacgccatattccatcggtctttttctctgaacgaaacagtgtctatgaaacccaagaagcacaagatttacgcattattctttctgcgtgtttaaacccttatcgtcaatctagcttgctttcggctattggtacatcgctttggggtttaacatcgaccgacatttttaatatcaaacaagatgaaaaagcgtgggataatgtggtggaaagctttgttggctatcaacaagtttggttacatcaggggattttaccgatgttgcaccaaatttttgtgaaagaaaatattatccaacggatcaatgccttaccgaatgcggaacgtcgtattaccgatctgttgcatttagccgagttgctacaaggggcaatgccaaatttagagaacgagttcgccttgctacgttggtatgaacagcaattagacaatccagatggctacgccgatgaacaaaaacagcgtttagagagcgaagagagtttggttaaagtggtgactatccacggctcaaaaggcttggaataccctgtagtttggttgccgtttgtggctaaagcaagccaacctgccaaaagtaaaccaataacaatctatcaaaatgacgaaggcaaggctcactggagcttcggctcacaatccgacgaaatcaaaaaatatattgataaagcagaatttgcggaagatttgcggttgctctatgttgcggtcacacgggcgaagtatcagctaaacctgattttaccaagtcaatttgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcattaaagcggagctgattacggttaataatgatgtgcctgaagacaattggcaaccaatactcgtgcaacctattgatattgaagcgaaatcctttacaggcaaaattcgcaccgttgggcaaattaccagcttcacggcattacaggctcaaaatgaacgtttgcaacataaagggcaaaacataccgcttgctacttttggtgacgaagctcaagattatgaccgcacagagttcatcgcctcggactttcttgaagataacgctcagccatatagtcgctaccaattcccacatagcacgaaagtcggtaatctgttgcataaattctttgagcattgggattttcaacaagcggtggatcaaacacaattacaggcattgtgtgaacaacttaatttagacgaagcgtggcttgagcctttaacaacgtggtttgagcaagttatccaaaccccatttggtgaacaagcggtcagtttaacgcagatttttacccataaacgcttgaacgaatggcaattttatttacgcctatccaataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacttaatcaactactgaaaaaacatagtccgttagccaaacagttgcctgatttgaccttatataacttagaaggctttgtgcgtggttttgtcgattgtattgctcaaattgacggcaaattctatgtgattgactataaatccaattttttaggctatttgccacaagattatcaagccgaaaaattagccaaaacaatggggcaattccgctatgatttgcaatatttgctctatacccttgccgttcaccgctacttaagcgctcgcttaggggaaaattataattacgagcaacactttggcggcgtggcttatttattcctacgaggaatgaatggcgagccaaatagtggtgtttattttgataaaccaagccaggagttgattgaagagatggataggttgtttgggtaagagatattctctatatcaataaagcccactttgagtgttttgtgggacgaataaaaagaaaaatgatatttattgtttcggattaatgtaattactccccatattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtctacgtaggcaaaaatacaatcctgtaaaagaagattatcctaagtaatttaaatatcatcacaacactcaataaagaatactttaattgaacaaaaagctgactctggctctaacccattatcagcccttaataattaaatagtgcaaaaatccacactctcaaatcggatacagcttacgattctttttctagcgttgtctgaattgccaactccgccaacgctttcgggttaccgaaacttggtgcatcggtcatcaagcaagctgccgccgttgttttcgggaaggcaatcacatcacggatattttctgtgccagtaattaacatcgttaaacggtctaaaccgaacgccaagcctgcgtgtggtggtgtaccaaattttaatgcgtctaacaagaagccgaatttctctttttgttcttcttcgttaatgcctaaaataccgaataccgtttgttgcatttttgggtcgaaaatacgcacagagccaccgcctacttcatagccgttaatcaccatatcgtaagcatttgctactgcaccttttggatcttgcacaagctcttcagggcttaaatcttttggtgcggtgaatgggtggtgcattgctgaccagttaccctcatcatctttttcaaacattgggaaatcgacaacccaaagcggtttccaagcggtgagatccgttaaacctaaatcacgtcctactttcaaacgtaacgcacccattgcatccgtaacgactttttcactgtccgcaccaaagaagatgatatcgccgttctgtgcattgacacgagtgagtaacgctttaaccacatcatcagttaagaacttagcaatcgggctttgtaagccttctaagccagcgtttacatcattcacttttgcccacgctaagccttttgcaccatagttcccaacaaattgagtatattcatcaatctgtttacgggtaattcccgcaccattcggcacacgaatgaccgcaacacgcccttcaggatcgtttgctggaccactgaatactttaaattcaacatcttttagaatatccgccacatcaactaattctaacgggttacgcagatcgggtttgtctgaaccataacgacgcattgcttctgcaaaagtcatttgtgggaactcgcctaaatcaacatttaaacgatctaaccacaagccgcggatcattttttccatcattgcacgcacttcaggggcggtcataaaggtagtttccacatcgatttgggtaaattcaggctgacgatccgcacgcaaatcttcatcacggaaacatttgacgatttggtagtaacggtcaaaacctgacatcatcagcaactgtttaaataattgcggtgattgcggtaacgcatagaatttgcctttatgcacacggcttggcactaaatagtcacgcgcaccttcaggagttgctttggtgagcattggagtttcaatgtccagaaaaccattgtcgtccatatagcgacgcacaaaactggtaatttttgcacgggttttcaaacgttccgccatttcaggacggcgtaaatctaaataacggtattttaaacgctgttcttcggtgttgttctgattgaaatcgagcggtaatacgtctgaattgttatataccacaagttctttgaccaacacttcaatttcacctgttgccatctctttattaatttgagatgtatcacgagcaatcacttcacctttaatttgcacgcaggcttccgcacgcaatgcagaggcttgtttgaataaggcttcatctttctcatcaaagaaaacctgcacgatcccttcacggtcacgaatttgcataaaaataaaacgaccaaggttacggacacggtgtacccaaccgcttaatgttacttgctcaccaacgtgagtacggtttaacacaccgcaataatgagaacgcatcatatctagttatccttcttataaaatttggaaaaaattgtggcgattatagcgaaaacagaccaaagaaaacagataacaatggaaaataatcatttaagccttgaaatcccgtaatttgtcgctatattagcggtcgttttagtgcaaaaatttgcgaagtcaaaatttgaggatacacaatgacaaaccaaactgaaaaagaacaagtagaacaagacgttagccaagcaactgaattagcacaagaggctcaggaagctcaaacacaagatgttgaacctgagttgcaacaaaataatgaaatcgatccgcttgaagaagctattgctcgtgtacaagagctagaagcctatattgctgaagcggataagcgtgaacaagatattcaactgcgtgcaagagcggaagtcgaaaatattcgccgccgtgcagagcaagatgtagaaaaagcccataaatttgccttagaaaaattctctaaagagatgctgactgttgtcgataacctagagcgtggtttacaggctcttgaaggggttgatgaaagcgtaaaatcaggcgtagaattaacccataaaggcttggtttcaaccttaaataactttggtgttgaagcagtcggcgtggtgggtgaagcatttaacccagagctacaccaagcaatttcaatgcaaccagctgagggcattgaagccaaccatattagtgtagtcttacaaaaaggttacacgctacacggacgtgttatccgtccagcaatggtaatggtcgctagttaattttctgtttttcgacggcgatcacaaaattagccccaaatacctgcgtgatttatgttattttttgataacactaatcacaaagggaataaaaaaatggactcaactatgagtattcgatttgataaacttcgctttgtaaaaaagctacaagaagctaatcaaccacctgaggttgctgaggcgtttgcaacagcgttagatgaaacacttgagcaaagtcaaagtggattagtcaataagtcagatttaaaagagagtcttaacgaactaaaatctgaattaaagcaagaaattgctcagcttgaagtacgtttgacaacatcaatgtataaaatggctggatttatgtttgctggtcttggtgtattaatgggactaatgcgatttatcaactaactaaagcaaaacacaatcccttatttgtttatcaagtaagggattttcaccttaaataaacctatgtcactacaatttaattctgttgccctactgcttgttgcacttatcttactcggtattttcagtcaaaatagtgctgtaaccatttctgctgctgtattattgattatgcaacaaacgttattatcaaaatatgtgccttatttagaacaatatggtatcaaaatcggcattatcattctgactatcggcgtacttgcccctcttgtatcagggcgaattgccttgcctgaacttgttcaaccgattaattggaaaatgatcgttgctattattgctggcatagtagttgcttggcttggcggacgtggcgtaaccctaatgggcaaccaacctgtgctagtcacagggttattaatcggcactattatcggtgttgctttcttaaaaggcgtacctgttggtccgttaattgctgctgggattttgtcgctcatcataggaaaatcgtaatttaccattgaaatatgcaaaaaaaccataaaaaccaaccgcttacagcagaacaaaaaaacttacttaaccaactccaagataccactttaattgatgctcgccgtttagccaggcgtattcgtgggttggcgaatatcaaaaatgaaaacgctaaacaagccatcattgcagaaattgaggtggatttgaccgcttgtaaaagtcgctatctcacgcgtaaacaacaatcagaacaactgaaaattgagtaccctgatctgcctgtttccgctcgccgtgacgagatcttaaaactgattgccgaacatcaagtggtggtgattgctggggaaacggggtcgggtaaaactacgcagttgccaaaaatgtgtttggaactagggcgtggggtgaaaggactaatcgggcatacgcaacctagacgtatcgcggctcgctcggtggcgacacgcattgcagaagaattgaagtcagaacttggttcaaccatcggttataaaatccgctttaacgatcagattagcgataacaccctcgtcaaattgatgacggacggtattctgcttgccgaaatccaaaacgaccgctatctcaatcaatacgatacgctaattattgacgaagcccacgaacgttcgcttaacaatgattttattcttggctatctcaaacaaattttagcaaaacaccctgatttgaaggtgatcatcacatcggcaaccattgatgtggaacgtttttctaaacatttcaacaacgcaccaattattgaagtatcaggcagaacttatcctgtggaagtgcgttatcgcccgattgtggaagaagatgatcaagaccaactgcaaggcattctcaatgcggtggacgaactgcaagcagaaggtcggggcgatattttgatttttatgaacggcgagcgagaaattcgtgatactgccgaagccttgcagaagcaggaacttcgccatacggaaattttaccgttatatgcccgtttatctgccgcagaacagcaacgcatttttaatccaagtaatctaaaccgcattattctcgcgactaacgtggcggaaacctcgctgactatcccaaatatcaaatatgtgattgatacaggaacggctcgcatttcccgttatagctatcgtaccaaagttcagcgtttgccgattgagccgatttctcaagcctccgccaaccagcgtaaagggcgttgcgggcgtatttcggaagggatatgtatccgcttgtattcggaagaggattttaacgcccgtccgcagtttaccgatcctgaaattttgcggacaaatttggcttcggttatcttgcagatgacggcgttgggtttgacggatattgcttcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaataagcctatccataaactcagcaatatcggtcgccaactcgcccaactgcctatcgatccccgtctgggtcgtatggtgatcgaagcggctaaaaacggcagtttgcacgaagtgatgatgatcgtatcggcgttgtctattcaagatcctcgtgagcgtccgcaggaaaaacagcaatcgtcagatgataaacatcgccgttttgccgacaaagagagcgattttttagcctttgtgaacctgtggcattttattcaagagcaacaaaaggaactcaccaaaaatcagttccgcaagctctgccaaaaagattatctcaactatttgcgagtgcgtgagtggcaggatatttatcatcagcttcgccttgcggtgcgtgaaatgggcttgccgattaacagtgagcctgcaaattatcagcaaattcacaccgctttattatcgggcttattgtctcatatcggcttgaaagataacgaaaaaatgcactatttaggggcgagaaatgcccatttctacctgttccctaattctgtgcttttcaaaaaacagccgaaatgggtaatggcggcagaattggttgaaaccactaaattgtgggggcgaatggtggctcggattgagcctgaatgggttgaaccgcttgccaaacacttaaccaaatccagttacagcgaaccacgttgggcgaaatcaaaaggggtggtggttgccgatgaaaaagtctcgctctacggtattccgattatcgccagccgtcctgtgatgtatggagcaatcgatcctgttgtcagccgtgaaatttttatccgctcagcgttggtggaaggtgaatggcacaataattacaaatttttcaaagaaaataaccgcttgatcaaagagatcgaagagttggaacataaatctcgccgtcgagatattttagtggacgagcaagtgctgtttgaattttacgatcagcggatcggcacagatgtcgtttccagcaagcattttgacagctggtggaaaaaagcgtcacagaaagatcctgaactactgaactttgaaaaatcgttcttgatgaatgataatgcaaacaaagtcagcgaattagacttcccaaatttctggtatcaagattcgctcaagttgaagctgagctatcaatttgaaatcggctcgcaagcggacggcgtgacggtacatattccgttgccgttgctgaaccaagtggatacgcacggcttcgactggcacgttccaggactacgtcaagagcttatcattgccttgattaaatcgctaccgaaagccactcgccgtagttttgtacctgcaccaaactatgcagaagcctttttatctcgtgcagagccgtttaaaaagccgttgttggaaagtttgagttatgaacttcgccgaatgacaggggttttggttgagcctgaacagtgggatttaagccaactgccaccgcatttgcggatcagcttccgtgtgattgatgaaaaaggcaaaagccttgcggaaagtgaaaatcttgatgaactgaaattcaatttgaaagacgaagtgcaaaatactctgtctaacattgccgatgacggcattgagcaaagcggtgtgcatttgtggaattttgccgatttgccacaattttacgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattttagcgtaaaagcctaccctgcgattgtcgatgaaaaagatgccgttgggatcaagctgtttgaaacggaatttgagcaagccaaagcaatgcaagcaggcttacgccgattgttattgctaaacgtgccgtcgccgattaaatatctgcacgaaaaactgccgaataaaaccaaacttggtttatattttgctccgttcggcaaggtgctagaactgattgacgactgtatcgcctgtgcggtggataagttgatggaggagtttggtggctttgtgtggtcggaagaaaaatttaacgccctgcacgactacgttagggcgaatttaaacgacaccacggtcgaaattgctaaacaggttgagaaaaatcttacccttgcctatgaaatcaacaaacgtctaaaaggtaagctggatttcacgatggcatttgccctgtcagacattaaagcacaaattgacggtttgatttaccccgattttgtcaccaaaacgggctacaaacgccttgcagatttacaccgctatctcaccgctatcgacaagcggttagataagttggtggtggatagcaatgctgaccgatccaaaatgttgcgagtggaacaggtgcaaaacgcctatcaacaactgttggcgaaactgccaaaatccaaaccgatttccgatgaagtcttagaaattcgttatatgattgaagagttgcgtgtcagcctgttcgcccaacagcttggcaccaaatatccgatttcggataagcggattttgaatagtattcaccaaataataaaattttgaaaaaacacttaaatttgtaaaattatgtaaacaaacttgtctacctttatgataattattatcatctagccacttccaaaaataataggtaatcactccaactcttacgcctcattcccccacaaaatgaggcgtttttttcgccttttttcttcgttctccgctataatagccagtatttttcgcatatagtaaaaggaataataatgacacaatctattgaaaccgttctcgctgaacttaaacgtggcatagaagatgtttattcagaagcagatttaattgagaaattaaaagaaaatcgtccgttacgcgtaaaacttggagcagatccaaccgctccagatattcacttagggcatacagtcgtgttaaataaacttcgccaattccaaaattttggtcacgaagtgattttcttaatcggtgacttcactgcaacagtcggcgatccgtcaggtaaaaatgcaactcgtccgccactttctcgtgaagatgtattacgcaatgcggaaacctataaagagcagatctataaaattttagatccacaaaaaacccgtattgtgtttaactctgattggttaggcgaattgggtacggttggtatgattcgcctagcgtcaaactacactgtggctcgtatgttagagcgtgatgacttcaaaaaacgttttgctaacaaccaatctatcgctattcacgaatttatctacccattattgcaaggtcacgactctgtggcattagaagcggatattgagcttggcggtacagaccaaacctttaacttattgatcggtcgtgagttacaaaaagcggcagggcagaaaccacaggtcgcaatgacattaccactgcttgttggcttagatggcgagaaaaaaatgtcgaaatcccttggtaactacatcggcgtgaccgaagcaccaaatgaaatgttcggcaaaattatgtcgatttctgatgaattaatgtgggattggtacaacttactttcattccgtccattaactgaaattgcacagttaaaagccgatgtggaagcaggtaaaaacccacgtgatgtgaaaattttattggcgaaagagattatcgctcgtttccattctgaagcagatgcagatgcggcggaacaagagtttatcaaccgcttccaaaaaggtgcaatgccggacgaaatgcctgaatttacctttgaaggcgaaatcggtttagcgacattattaaaagaagcaggcttagtgccttcaacttctgaagcaatccgttccgcacagcaaggtggcgtgaaaattgacggtgaaaaagtcgatgatgtgaaacaaaatgcacagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggacttttgtttaccaagtcggtaaacgtaagtttgcgagagtgactgttaactaatcctcaaaatcgtactacctaaagtctttattgcaaactattcaattcagcagaagagcttagtttaaattcaagctaagctctttatgttatatagcattactctctttatattcaataattactctaggtgttaattttgtaataagttcataattgatgacaccaatagcttccgcaacttcttcaattaaaagtttatccccccaaagctcaacttcgtcacccactttatcctgactatcaacaccaagatcaacggtcatcatatccatcgaaacacgtccaacaataggaaccttacgcccattaacaaaaacaggcgtaccttcaggggcatttcgaggataacctacccaaaccgccatagcccacaggctcaccagctttgtggctgcgaaccgcaattagagaagaagataatgtcattacgggtttaaaacctaaatcaacaattggcgttgagtgtggagaaatgccgtacataataatgccagggcgaacccaatcataatgagcttgtttccaataaagaataccgcttgaagcagaaatactacgctcaaccttgtactcttgactgaccgtctcaaaagtagcgatctgcttttcggtataatcacaatcaagctcatccgctcgactaaaatggctgacaaagtaaatacattctacgagaggacaagcggttaaacgttgataaaattctgcaacttgttcggggtgaatacctaaacgatgcatacctgtatcaatcttaagccaaacagtaatcgggaaataaattttggttttacgctgccaaaaacctttctgcttttccgcttgccactcttgagccacattttctagcagttcaagttgctcaaggcaatgaataacggtatcgaaacgacgggaaagggtttttaataattcttcacgatcaaaaaaaccttcaagcaataagattttacctgcatagccactttcttgaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaatgcttctttaatgcgagcgacaccaaaagcctctacctgatcttctaaattcttaatcacggctctaataccttgcccataagcattagctttgactaccgcacaaattttactttgaggagccaaagatttaattaaacgcatattatgtcgtaaagcactaccgttgatcgtcgctgttgctggtttcatcgttttaaagtatctatttgaaaatgttcgaaattatacgctgaaattgtaaaaacccctagaatttcaggaaaaatagactaatatataggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactaatatataggcaattgtttaacctatattaaggagaatatgatgttatctgaattgatgattttacccttcgtcttcgttatgttgactattgctattttactatcgtcaattaaaaccgtgccgcagggatttcattggaccatagaacgttttggacgttataccaaaacattaaccccagggttgaatattgttattccttttattgatagggttggacgtaaaatcaatatgatggaacaagtgctagatattccatcacaagaagtgatttccaaagataatgcgagtgtggcaattgatgccgtttgctttgttcaggtgatcgatgctcgtcgtgctgcttatgaagttaatcatttagagcaggcaatcatcaatttaacgatgaccaatatgcgtacggtactcggttctatggatttagatgatatgctttcacagcgagatttgattaacggtagattattagccattgtcgatgaagccgcaaacatttggggtgtcaaagtaacgcgtattgaaattagagatgtgcgtccgcccaaagagctagttgaagcaatgaatgcacaaatgaaagcagagcgtaataaacgtgccgatattttagaagcagaagggatccgtcaagcagaaattttgcgtgcagaaggggaaaaacaagctcgcattctaaaagcagaaggtgaacgacaagaggcattcttacaagcagaggctcgtgaacgtgcggcagaagcggaagcaaaagcaacacaaatggtgtctgaagcgattacaagcggtgacactaaagcaattaattactttattgcacaaaaatacactgaagcactgcgtgaaattggtgctgctgacaacagtaaagttgtcttaatgccactagaggcaggcaatttaatcggatctgtggctggcattgctgaattacttaaaggcgataagaaataagggggaaatatggaatggctttcgggctggactgcttggctgatttttggttttattttgcttattctagaaactctcattgcagggatctttataatgtggtggggatttgcagcgattattgttgcaatactactcatattattccctaatatcgaattgggctggcaagccactatttttgcgatcttagctattctgtttagcctcgcttggtggaaatatcagcacagtaaagatcagcaagaagatcaacaagccgatttaaatgcccgagatcacgcaatgatcggcttacaggggactgtcgttgaagttctcgacagcggtgttgcaagaggaaaatttggcgacacgacttggcgagtgattggcaacgcattacaagttggcgataacattcaagtagaaaaggttgatggcattaccttgtttgttcgtgttgtatagaaaaattctgacaataaaaaaccgcttgttttacaaaacaagcggtttgatttttctaaattttaccaatgaatttattctgctttttcagttttctcttttggtaatactaaatttaagataattgccacaatcgcacagaggctaataccttttaacgagaactcgcctacgttaattagcattccgccgataccaaatgtcattactacagacacgatacagagattgcgagcttcgctcatatctactttcgcacgaattaaggtactcatacctactgctgcgatagaaccaaatactaacatcataataccgcccatcacgacagctggaatggtttgtagcaatgcccctacttttccgcagaaagagattgcaatagcccaacatgccgcccaagtcatcacttttggattgaagtttttggtgagcattaccgccccagttacttccgcataggttgtatttggtgggccgcctagcattgcagcagcagatgttgccacgccatcacctaaaagtgtacggtgtaaacctggtttgcttaggaagtttttccctgtaacagagctaatcgccataataccaccaacgtgttctactgctggtgcaagtgcgattggaagtaagtagaggattgcttcaagtttaaattcaggtgttgttaattttggcaggctgaaccacgccgcatcataaacaggttggaaattcactaaaccaaagaagagtgacacaatatagccgaccacaattgcgaacataatcggcacaagtttcatcatacctttggtaaatacagccacaattagtgtggtaattagggtaatcattgaaacagtaactgccgttgcataaggaatatcagtgcctttaccgatagccatatctacaccgacgggtgctaagcctaaaccgataatgatgattactggaccaactacaacaggtggaaataacttatctaaaattgccacacctttaaatttaactaatgcggaaaggacaaaataaattaaaccagagaaaacaattccccccattgtgacagggattccccactgctgaacgccatattgaatgggtgcaataaacgcaaaagaagaagcaaggaaaataggaacttgtcctttagtgcagatttggaagattaaagtaccgataccggcagtaagaagtgctgtgttaggatctaagcctgtaatcaatggcattagaaccaatgctccaaatgcaacgaaaagcatttgtaagccaacgaacgcctgtttaggcgtactgatattttctgttgtcatttttcaactctctaataatgtttgatagtcgccaagctacaagacatagctcaggcggacattatatagaaaaatgcaaacgtttgcagatttttttgtcaaaaaaattaattagataggcaaattttgtaaaggcagaaagtgatattgcatagagataatgtgagcacacaacgtgtgcccacaggacgaaattatccaacccaaacaaatttagcaataaagagcagtgaaaccaccgcaacagcagggttaatctcttttactcgacctgtacagagcttcataatgcaatagctaatgaaaccaaaggcaatcccttcagtaattgaataggtaaatggcatcatcgctgtagtaataaatgcaggtgtcgcttcggttaagtcgtcccattttacttcaattaaacttgaagccattaaaatgccgacaaacactaaagcaccagccgttgcataagtaggcacaacagctgcaagcggtgaaaagaagatcgttaataggaaaagcacgcccaccacgacagcagttaaacctgtgcgtccaccaacagaaaccccagaaccactttcaatataggtactgatcgctgatgttcccatataagaacccgccatagcgctgacgctatcgacataaagtgcctgtttcatttttgggaagcgaccttgttcatcggcaattccagctttattcgtaaccgcaattaatgttcctgatgagtcaaacaagttaaccaacataaaggaaaagataatccccagcaatgcggtatctaatgcccctgcgatatcgacttgtccaacaacagcttcaaggcttggtggtattgaaatcacgcctgagaatttgacatcaggatcaaagattaacgctaatgccgtcacaacaacgattgaaattaatacgccagaatgaataccttttgcagccagtaccacgataataaagaagcctaaaatacccattaagacttttggatcgtgcaattcacctaacgccactaaggtcgcagggtttgcgacaacaagccccatatttttaaagccgattaacgcaataaataagccgataccagcaccaatacccacacgtaaaccaagtggaatggctgacataaaccagtagcgaacttgtaatatcgtgagaataaatagaccgacagaaccccagaagattgcccccattcctgtctgccacgtatagccgagtttttgaacgacgacaaatgcaaaaaaggcattcaatcccattgcaggggcaagagcgatcggcaagttactaaataaacccatcgcaatagtaccaaaagcggcgattaaacaggtggtaacaaagacaacttgggtatccataccagccacacctaaaatagatgggttgacgaaaacgatataaaccatcgtaaagaatgtggtgatccctgccacaatttcagttttgacattactgcctttttcttttaattgaaacaaacgttcgagcatagtgcctcttaatagaataaagaatttcaggaaataagatggaaatgaaatcgacgaaggcaaccgacagtactaaatgcacaaagagataggaagtcttggctatttcgttcagagtgtagccaaaatcttaggattactcaagggatagaatgtaaaatacgtaatcgtttgcttatttaagcattattctacaaaataatgtggtacaaagtggctatcattccctgtaattgcggtaaaatcttctcgaatacctataccacaagcagtatccccaacaatccaagagcctataactggatacattccatcaaagcaagggattgcatatttttgttgaaatacatagggggctgtcctagataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagcataaacaaaataaactcattgagctgtttgtggcaggtgtcactgctcgaacagcggctgaattggtaaatgtaaataaaacgacagcagcctattacttctatcgtctgcgattgcttatctatcaaaacagcccacatatggagatgtttgaaggtgaaattgaagccgatgaaagctatttttgcggcactcgcaaaggtaaacgagatcgtggagctgtgggtaaaaccgctgtattcgggcttttaaagcgtgatggtaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtataccgtcgttatcatttttcaactctctataattgaactaggatttatgtaccatgagtgatgaaaaactttgtgatacaggcatgatttcaatgctatttacattcacatgattaggttgttgattcagccacaatactatttctgcaatatcttcgggttttaaatactctacattttcataaagtttagataccttttccttatcacctttaaagcggacatacgaaaactcagtatcaccacataaccccggttcgacattactcacacgtattgctgtcccaattagatccgctcttaaatttaaactaaattgtttcaaaaaagccttcgtccccccataaacgttacctcctggataagcatatgtgccagctattgatcccaaattaataatatgcccagtatttctttctaccattcctggtaaaatcaaatgggtgatagtaaccacccctttgatattggtatcaatcatttggtaccaatcatctaaatctgcttcatatgcagcatctaaacccaatgccaaaccagcattattcactaataaatcgacatgtttccaacaatctggtcgattatttagagcatgaatcgtttcatctgcattacgaatatcaaaagcaagcggaaaaaaatgatctgggaattcatcttttaacatctttaaccgttcaatacgtctccctgtaccaataactctataacctgcctgaatcaacgttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaccgaatccagaagttactcctgtcaccaatgctgttttcataattcccctccctaaataccataggtaaaaaaatattgaaggataaaaattgactatgagttattgtcaccctctctcaatagttttgcgattgcattacgataagtgatctctaagctctctcgacttgtcgccataacaccttgatcatttaagaacccatcattaacatcatagacccaaccatgaatagagagtttttttcccctctcccaagctgatttaacaatagttgaacgtcccaaattataaacctgttccgctacattcaaacgaactaacatatcccccctatgttcgggagatatttttccaagaagatggctatgtttaaaccatagatctcgaatatgcagtagccaattgctaattaaaccatgatcttccattccaattgcagccttaataccgccacagttggtatgcccacaaataataatatgttcgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataataatatgttcgatatccagcacatccacagcatattgtacaactgaaagacaatttaaatcggtgtgaatgacaagattccccacatttctatgaacgaatagttctcctggctctaatcccgtcaacttctcagcaggaactcgactatctgaacatccaatccataaaaaactaggtttctgatgttctgctagctgtttaaaataatctgaatgctcatctttcatttgagttgcccaagcatgattatttgcaaacagacgttcaatttttttcataaattcccatttagtataaaaaacaaccccccaatttgaaattgggaaagaacaattcttattcaaagattaatgaataaaaaggttttcatcttattatgagtactcatatccgtcaaatttaatcaataattaaactcaacgagcagagagctccccataaatggatagaacattatatagtaagttttatccctccaataaatccaatatgctatagcaaaatagcggggaagctcctacaagtctaatctgatcacataagtatgattgaattttactgttttcatgtagcatctaccacgttttttgtttaagatgaaacacaataatttctttccgaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcttcgctgtgaaaatatcagcaaattttaccaagagggcggaaatgccactcaggtgcttaaaaatgtctccttttcaatgaacgcaggcgaacttgtggcgattgtcggtagctctggctcaggcaaaagtaccttgttacacacccttggcggtttagatcaaccgagtgacggcgaggtgtttatcaaagggcaatcattgcagaagctcagtagcaatgctcttgcaaaactacgcaatcaacatctgggctttgtctatcaatttcatcacttaatggcggatttctctgcgttggaaaatgtgatgatgccaatgttaatcgggcaacaaaacaaaacagaagccaaagatcgggcagaaaaaatgttacaagcggtcggtgaacgccagcgtgttgcgattgctcgtgcgttggtgaataaccctgcgttggttcttgctgatgaaccaacgggtaatctcgaccaaaaaacaaccgaaagtatttttgagctaattcaacgtttaaatcaggaacagcagattgctttcctgttagtgacccacgacttgaatttagctcacaaactgaaccgccgtttaattatgcaagacggtgtattgcgtgagggtaactgatgaataccccattttttatcagttggcgttatcagcgtggcaaacagaaaaatcgcttggtgtcgttgatttcgctcttttcgagtgtcggcattgcgttaggcgttgcggtgctgattatcggcttaagtgcgatgaacgggtttgaacgagagctaaatcaacgggtgctttccgttgttcctcacgctgaaattatggcgtataacgaaagcaaatctgcgaccattgtacaaggtgatcgccttgaaaatattgtaaaagatacccctaatgtgaccgctttatcgccgtttgtcagctttaccagcttgattgaaaacggtagtcagctaaaaattgcacaggttcgtgggatagatccaaccaaacaagaacaagtgagccggctcgcccaatttattccgcaagatcaatggcaagcgttcaagcaagagggcggtttaattttaggagctggaattgctcgttctttggatattaatgtcggcgatgaagtcaccctgttattgccacagccaaccgacgacggcaaattggctcaacctttacgttttagcctaacggtaacaggtattttgcgtttagacggacagcttgatcacagttatgctctgcttccgattgcaaaagcccaagaactgttagaactgaaaccaagccaatatacaggcattgaattagcggtgaaacagccgtttcaagtcagagagattaccttccctgaattagcgaattacccacagcaactatatatgcaaacgtggatcgataaatttggctatatgtacaacgatattcaactgatccgcacggtgatgtacattgcgatggtgcttgtgattggtgtggcgtgctttaacattatttccaccttagtaatggcggtcaaagacaaacagggcgatattgccattcagcgaaccttaggggcaaacaaccgctttattcagcacattttcctttggtacggtttgatttcaggtatgaaaggggcgttattcggcgtggtgttaggtgtggttgtatcaatgaatttaactgcgattattaaatggtttgaaagtgtaatcggaatgaaattgctctcagacggggtctattttattgacttcttaccgagcgaaattcattggctagacattgtttgggtacttctcgccaccctaattttaagcctaattgcaagcctttatcctgcaattagagcgtctaaattagaaccagcgaaggtgttgagtgggtattaaatacttttagagtatgactatttagaacggaagttatatcaatcccaacaccttccgcccattcacacttgctatgttcgccatctcttcgaggttggtaaaacggcagccggcggaaagtaggctaagttcttgccacatatccccctcacaaagaggaaccatatagtcacagatattatctgtaccaattgctacagtaattccctctgggatcatctcatcagcaggcgttaaagcattatggaatggtaaaacttcatctttacgaggactatcaatccacgccatcgggcaagcaatcatcatcatatcaacggctttcattttcttataaagcatctgacgatactctctcgggtgagcaccgattgaaatcccgtgaatagccaccacacgcccttgcattccgtgttccaccgctttatcacacagttgctctgtttctttctctttaggattgttaaattgatcgacgtgaacgtgcagcattttaccttgtgattttgcggtatccattaaaatatccatcgcttctaagccttttccgtagtccaattcatcacgataaggtaaaccgccaatcatatctaccatttctgaaccaatatcaaaccacttgcgagcattaggttcgattacaccttttaaagtttgatttgcaaaacgtagaataatatcgtttttatacacttcgcgtgctttatgtgctgccaaaatcgcacggtcttcgcagacttggtcaatatcaacgaaagtcccaaatgcagttaccccttgtgaaatcatcaactcaatcgcttggctaaaacggcggtaataatcttctacgcttgaatttcgtttgacttcatcaactaaatcccatttctgttgtaaattggcattttgataaattttgattttctcaggtgtcatagtgaatgctctatctgcgtgcgcgtgggaattaacccagcccccttttttaatcacttcatcacgaatatggctttttaaagtacgaattaactggctcattgcttatcctctaaaatatgggcaaaaaaaaatctcaaaaatgagatcttctagaaatggaaaaataatgcgataaaaaaacagccaagcttcgttgaatagcgaagctcagctgaaaaagtgtgttggatactgttatatgatttggttgcatttctagttcctttcttggcactaggactacattttatcttgtttttcttctcaatgcaaacgtttgctttaaataaagtatcaaattttaagcggtcggttctcttaataatttttcaattactcgagaaacggcaaaaaagccaaaagtggcagtaaccatagtcgctgcaccaaaaccattggcacaattcattgttgcagacacttcacagccctcgctcattttagggaaaatcaatggctgagtagagaatacacaatcaataccaaatttacgtttagggttttggctgaaattatactcttttcgcaataggctacgcaccttagacgctagaggatcttgaatagttttacttaaatccgtgatctgaatttgcgttggatcagtttgcccacctgcaccgcctgtggtgattatcttgattttattacgcttacaaaatgcaattaacgctgctttcaccctaacgctatcaatcgcatcaatcacataatcataatctcttaacaaataatcagttaaattatccagtgtaagaaaatcatcaatgatcgtcacttcacattcagaattgattttagcgatccgctcttccatcacttccgttttcaatttaccgatctcgcccgacattgcgtggatttggcgattaatgttggtgacacaaatatcgtccatatcaattaaggttaatttaccaatacctgaacgagccaacgcttccaccgcccaagatccgacaccgccaatcccaatcacacaaatgtgcgattgacgtaatttggctaatccttcagctgtataaagacgaccaattccgccaaaacgttgttcgtagttgtctattcttgccatgttaatcctttagctctacataaactacttcgaatttgttgagggttaatgcaacttcatcgttggtcttaaaaaacgattaattctaccaaccaacataatcaaccctgttttgacacaaccgtgtagagccacttggtgcatacgatagagtgaaaggtatgccatacgggcgatcttcccttcaataaacattgagcctttagttaaattccccattagactacctactgtaccaaaacgagagaaagaaattagcgagcctttatcatcaaatataaaagcctttaaaggtttgttttctaattgtgctaagatatttttaccacaaaccgttgccatttgatgtgcagcttgcgctcttggcggaacaggcttaccatctgcttgtagcaaaaaggcacagtcaccaatcacatagacgttctcatcagttaatgtctgtaaagtatctttgattgcaatttggttaatacgattagtttcaaagccaaatgtttttgttatttcaggggccttaacacctgccgcccaaaccatcagatctgctttaaagttttcatcatatttagtaactaatccctccgcagttgcacgaataacaggagtattggttaacacatctacacccaatgcacgtaactctttaattgcagatgccgataccctttctggtaacgcaggcaacaagcgttctcctgcttctaataatgttaccttcaagctagtattatctaacttaccatatccataagaatttaaatgtttaaccgcattatacagttctgcggataactcaatacctgtagccccgccaccaacaacagcgatatgaacttctttttcattattatttgaaaatttcaaaaacaattccatcatacgtttatggaatacttttgcttgctctgaactgtctaagaaaatacagtgttctgcaacaccaggcgtattaaaatcatttgagcgacttccgattgcaagaaccaatttatcatagacaatggtacgttccgctactaataattcccccgcctcatcatagattggggctaatacaatgattttttctgctggtttaacttgagttaatgtgccttgacgaaattcaaagtgatgatttttcgcatgggcacgataacttaaagcatcagtaccatcatctaaagagcctgttgcaacttcatgaagtaacggtttccataaatggctaatatttttatccaccaaaataatatttgcctttttctttttacctaatttgttacctaaataagttgcaagctctaatccacctgcaccgccgccaacgataacgatcgtttccattgtttgctccgaaatgaataaatattaaaactaaaggcattctaaaccttagctactgaatgatctaggtagatttacaaattatttcagtggaataaataaatagatatttgataagttttgcacaggcaaatgatgtcaagtcaaaaaaggtgaaaaaatcttgatttttttacattttgcctctagtcaaaatgtaacatattgattttaaaagaaaagttattttatgtacaatcgtaaacccgcatcaaaaaccctatgaattatcaagggtttggcgtgttttaaaaaagtaatccacaaagttatccacaggctttgtggatagaaaaagccttattttttcactgattttatgaacagtaatgaggggcgatgttgaagatctttaaattcattgtgccattcaacttgatcggcaagcataggctcttccacttgctcaatggtgaaattgctttgaataagggtatttaaaatagtggcggtagtgcggtggtaagttttaaaagattgctgaaaccaattacgatcacgctcaccttcatcacggtaataatttaggcggtatgcgacttgttgcttattgattttttcccaacgctcaccttctttaaaacaagttacaatcgggtgttcttgcgaaaaaatcagttgcccttgtggttttaatttggcagaaatctgcgttaataaggcagataaatcttttatataatgaaaagcaaaagagcttgtcaccagatcaaaatcgctttctgctatggtggataagacttccatcggtaagcaataaaagcggtaagcggtcggatcaaccccgttttttgcaaaatctttttcagcttgttcaagcatagattgagataaatctaagcctacaacctgtttcgcccccattgccatataatgcaacaaatgcccaccagccccgcaacctaaatccagcactttttttccgttcagatcaggtaaaagcgaaaacatcgtaggcttttccaccacttcatttaggcttatcgggttttcacgcagtttaagatagcgtccaaagaaaatcgggttgtcgtagatgctggttttcatttgcaaaaatctctcaaatcctaccgcttgtaaatatcttcaccatcacggcgagttttcaagatacgcaagatccagacatattgctctggattttttggcacaaagtactcaatcacttcgttcatttgccgtgccgactgttgctcatcacctgcaaattcaagcggtggcaaaatttcaatttgatacacgcctttttccgcattgtaaatcgggaacattgggatcaccactgcatttgccacacgagccattttcgctagccctggcaatgttgctttttcagtcgcaaaaaatggcacatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatacacactaagctctgctccgaagtcttcatcgggcaaaaaataacccaaacaccctttacgcacatcatttaaaaagggtttaatcccattttgacgggtatgcattttaccgccaaaacgttcgcgagtgcgattccaaagccaatcgacaaggggattatgatgtgggttatacattgaaaccattggcattccataggtatgcataataatccccgacgcatcaatcgaccaagtgtgtggcacgagtaaaatcacgtttttcccatttgctctcgcttctcttacgatctctaaacccgaaaactcactacgtttttgaatatgttcaacagaacgcaacgcaatttcaccaattcctaacatcgtttgagcgacagtaataaacattttttcaatcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatcacgccaacgaaatggtacataagccaagatcactagtcccaacattcctagccaaattccccaatatttcgggtgtaaaaaggctttttgaaactgatgttgataacctactcgatatgtttcacgttctgacattcttttgtcctatttcttacggtcgataatatttttcaccgccaaaatcaatcccaaaccaataaatgccccaggtggtaaaatggctaatagcaagcctgaatctaaatgtagcagatccattcttaaggcttttgcccaactgcctagcaataaatccaagtcgtcaaacagtgtaccgttaccaataatttctcgtatcgccccaagcaccacaaggcttaacgtcatccccagccccatcgcaaaaccatcaaaagcggaatgggcgacactatttttggaggcaaaggcttccgcccgaccaataacaatacagtttgtcacaatcaacggcacgaaaatccccaaggattgatacacaggaaaggcaaaagcattcattaacaactgaatagtcgtcaccgcagttgcaataatcatcacataaatcggaatacggatatcgtgcggaataaccttacggaacaaggaaatgatcgtatttgtaatggtcaaaaccaataaggttgccaatcctaagcccaaggcatttgtgacattattcgacactgccaacaacggacacaatccaagtagctggactaaggtcgagttatttgaccatacaccttgcgtaaataaatttttccaaactgaagattttgcttcggctgtcgtttcttcaatttgcgtaatagggatttgggtttcttgcatattttatctcttgtagggtgggtcttgacccaccattttccataacatattgattttataggttggttaaaacctacccacaatgcttcatctattttgatgatgtattatcaatcttaaccattgagctttattaaccatcttcagtggatcctttatacaataaagcctattatttattaaaatttcttacatatcccactgatataaactgagcatatcatttttcacatcacttccccaatccatcggaaattttccattttgtacgtctttatgaaatgatgaataagcccaatcagatacattttttacataattatgtttcacagggttatagtaagtataagcaatatgtttttctaaatcttcttcatctctaatataatgctcccaaaaccgtctttgccaaatccctgcttcatttcgtttttcacgactaaaatttgggtttcgatgttctttgggtatcttttgagtaaatcttgttttcaaaaattttaatcttattgaatagtcatcatcattttcaggtaattgtaaaatcagatgtagatgatcaggtaaaatcgtaattgcaatggtttcaaacgagtatttctcaacagtttctttatatgcacaacgaaattcatcaatatatctaactaacaaatcgcttgttctatcctgcaaaacgatggtaaaaaaataaataccgccctgagtaaaattacgtcgataatttgacatactttttccaaaaatggtgggtcaagacccaccctacaatttattacaactcaaaaaaccttccaccatttcaggcttttgctttaactgagtaatcacccattttgcactttggcgaacattattcaccaccgctcttggtgtaatggtcgcaccagtaaattgatcgaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccgtctttttttaccgcccattcgccttcattttctaagctaaatttgcggttggtgaaactgtaaatccaatcgtcaattcgggtttcgattttatcacccagcccaggggtttctttatgggcaagggttcgcacgcctaataccgtgccgtcaggctgaatacctatcaacagctctatattgcccgaatagccgtctggaacggtagcttgaatagcgtaagcggttagatccgagcctttttttgccatatggattttatttaaaaacggcacttcaggaagtttaaccactttgcaagttgccaatagctcattatcaaaatgtacttgtggcacaacttctaataataattgccgttgctgttctgccgtaaccacatcaattcgacttttagtcagcagataaacgcccgttgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcagcagataaacgcccgttgaaaccgccgtacatagtaaggctatcgctcctaaaatcagagcgtaacgtgtggtaatcactgatgttttcattgtctccgtcctaattttgtaccgtataaacggggttgagtatagtggtcgattaacggcacacagatgtttgccaacaacaccgcaaacgccacgccgtcagggtagttgccataataacgaatgaaataaatcaacaaaccgaccaacgccccgaaaatcagtttgccttttggcgtgattgaagcggtgacaggatcggttgcaataaagaatgccccgaacatcatcgccccactaaataactgagcttgagccgtccaacgagccgtttctgacacaaaatctgtcgcaaagctcaacaaggcaaaagtccccaacatcgcaacaggaatttgccaatgaataattcgcttataaatcaataataaaccaccaagcaaaaaggctaaattcacttgcccccaaccgccgaccaacacatctgcaaaaagtttgtctaactgaatacctaaggtcacattatctttaatgctactcatcgcctgttttgagccgtctaacactgtggcagacgacacgccatcgacactttgaataagttgatgaacgctaaagccgtccgtggtgacattcgcaaaaatcagcgaaaaactatccgctaacgttggcggttcgttcaacaacgccaacggtggcaaccacgccgtcatttgcacagggaatgacaccaacaacaacgcatagccaatcattgcagggttaaataaattctgccccaaaccgccataaacgtgctttgccagcaacaacgccacgatcacgccaatcacaatcacccaataaggtgcatagggcggaatagccatcgccaaaattaatgcggtcaaaatccccgacaaatccgccaaatagaaagcggtcgctttaccacgcaattttgcaacggcaatttcaattaccaccgccaagccaatcgccaagctcgcctgaatgaatatcccgtaaccaaaaaaataccactgcacaaccaacgcaggcaacatcgccccaatcacccacagcataaaatttgccgtcaggttgttggaatgcgtatggggggaactgatcattttaaacatcaaatgtttcctttatatcgtctaaatttgctaaatcttcggcaaatgcatattaaatttaatcgtgagcattcggattgcaatgaccgtcgttaccgttgccacatcaatccaattactttcaaacccagcatcacggaacaaaataaaaataataccaccaacaagacttgcggtcacatacacttctttttgtaaaatgatcggcacttcgttgcgtaaaatatctcgaataagcccaccaaaacagcctgttacaccgcctaatgcaacacaaattaacgggtgcaagccaaaatccagccctttttgcacaccaattacagtaaacacccccaacccaatcgcatcaaaaatcaacaagccttttttccaataatcacggtcgatctgatttttcaaaattgccacaatcaccaccgccactgaaatcatcagcacataaatcggctgtttcatccaaaacacaggggtactgccaatcatcacatctcgcaaggttccaccgcccacgcctgtcacaaaagctaacacaaacataccgaaaatatccattttgtgctggcgtgccgcaatcgcccctgaaatcgcaaaaacaatagtaccaatcaagtcttgaataaacaaaaacgaccacggaaatgggggaaataattcgttcatttgtgttccttaattattagttcatttacttgtgtcactttcataacaataatatatgtagggacacactgcgtgtgtccgtaaatcaacgttgtgggggtttaactaatacggacacacgcagtgtatccctactatgctatttctgagcctcttttttcgctttcgctcttgcaatcgctgccgcaactgctgcttttcttggatcttccgcaacttcagcttttgcaacattttcatcagaaaccaccgcttgctgtgcttctttcttcgcttttgctctggctaaagctgccgcaactgccgctttgcgtggatcattcccctcgcccgcttgcgggagagggacagattcaagcgacgtaatgtcgcgagaatcagggctgcttcgccaatcgtcttgccttacgttgtgccatcaattcgctgttatccggttcaccgttagctttagtttgaaccggggtagccgtttctgcttttttcgcttttaagcgttcaagtgctgctttaaccgggtcttcaccttggctgtttgccacttcttcacggcgtttttcagccgcttgttgaatacgtgctgtgcgtgcttctttttctttatttaaacgagcttcacgagcttcaaaacggatcttcgcttcttccgcctgttttgctttttgatcgacttcttggatcttggctttttcttggcggaaatactgaataagcggaatgtaactagggcaaacgtaagcacaaacaccgcactctatacaagcatctaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttgatttatcgtgatcttctgcacgagcaaaccagtaaagttgttgcggtaacaatcccacaggacaagcatcagaacagcttgaacagcgaatacaatttcgctctggttctggcggtgcatattcaaagtgatcaggggcgataatacagtttgctgttttggtaatcggtgattgtagtgacggcaaaataaagcccatcatcggtccacctaaaaagacaggaaaacgttcatccgcttgataatccacttgttcaagcaaatgcaaaatcggtgtgccgagccttgcccaaacgttgcctttattgcggattttatcgcccgtcagcgtcaccactcgctcaattaacggctcatcgtccattaccgcacgttttactgcaaatgccgtcccgacattgtgcatcataatacccatctcaatagttcgtttaccttgcggaatttccagccctgtcagtacttgcaccaactgatcgcttgcccccgatggatatttagtcgggatcactcgcacgctaatatcatttgcaccttttaatgccttttcgaccgcttgtatcgctttcggtttattatcttcaatagcaatcaccacgtcttcagggcgaagcacatagcgtaaaatccgcacaccttcgatcatctcatcggcataatcttgcattaaacgatcatcacaagtgatataaggttcgcattctgcaccgttaataatcaacaacttacagcgtttatcggcaacatgtaatttgtgtgatgttgggaagaccgcaccgcctaagcctgcgatcccagcttggtaaactttttgaataatctgaccgcttgttaggcttaaaaaatcatcaatcggctgacgttcgatccacttatcttcgccgtccgtttcaatcacaatggttaattcgggtaagccagacgggtgtgatgaaacgtggggctgaatagcgaccacttttcctgaagtcggactgtgaacaggtagttggcgataattatccccttttgttaaggcttgccctttcagcaccaaatccccttgctgaacaatcacgtccccagccgttcccgaatgttgcaacacaggcacatagaaaaatttcggcagatgtaacgaacggatcggcttttggttcgactgttttttcatttcaggcgggtggataccgccagggaaatcccataattttccttcacgaatacggcttaataaatcagcttgcattacttctcccaaccacaattttcttttcaacttcagtggtattcacaatcgggatcaccaaattcgcatcaaatttccagttccagttttgtgtcgtttgtttcacttttatcatttcaatacaatcagtcgggcaaggggcaacacagagttcacaccctgtacaaaaatcggcaatcaccgtgtgcatcgctttgtttgtcccgataattgcatcaacagggcaagctgcaatacatttggtacaaccgatacacaactcttcgtgaatatacgccaccttcgccacaggctcttcccccgatgtttcaggcacatcaaccccaagcaactcggcgattttcaccaccgtcgcttgcccacctgggatacatttcgtaatgtcgtcgccatttgctaccgctttcgcatagggcttacaaccagggtagccacattgcccgcattgactttgtggtagcaaagcatcgatctgctcaacaatcggatcggcttcaactttcagcttaaccgacgaatagcccaacatcgccccaaaaatcaaggcaatcacagcaattgcaattaaaatatagagaataatggaatgatcgaacattagatttttaccaaacctgtaaagcccataaaggctaatgacatcaaccctgcggtaattaacgcaatggacgcaccttgaaaggctctaggcacatctgccgcgactaaccgctcacgcaaagctgaaaaaagcactaaaactaatgaaaaccctgccgctgcaccgaagccgtaaagcacagactgcacaagattattagataaattcacgttcaacaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcacgttcaacaacgccacccctaataccgcacagttagtagtaattaatggcaaatagatacccagtaaacgatagagagcagagctggttttgtgtacgatcatttcagttaattgcacaatcaccgcaatcaccaaaataaagaccaaggtgcgtaaaaactgagcttcaaggggaataagcagataggtttcgaccaaataagcagaaagcgaagcgaccgtcaaaacgaaggttgtcgccatacccataccgatagccgtttcaacctttttcgacacgcccataaacggacaaagccccaagaatttcacaagcacgaagttattgattaacgccgtactgataattaacagaatatactcaaccatttaacccacgaatttatcatcagaaaatctaaaaaatgtcgtgtattatcggcttttttgctgtaatgaacaacctatttacatcaactcacttacaagcggtcagggcaagatcgcatacaatgcatttcaatttgcaccttgccgaaaatcttgctaaagtgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgccgaaaatcttgctaaagtgcggtacaatttggtgcgaatttaatattaggaagaacaaatgagccaagaatacttagattttgaattacctattgcagaattggaagccaaaattgaatcgctacgttctgtcgccgaacaagacgataaaattaatcttgatgatgaaattgcacgcttgcaaaagaaaagtgtggaattaacacaaaaaacctttgcaaatttagacgcttggcaagtttcccgcatggcgcgtcatccaaaccgcccttacaccttggattacattgaacacatttttaccgattttgaagaacttgccggtgatcgagcctttgctgatgataaagcgattatcggcggcttgtttgatgagctacggttattgttaatcaaatgatttgttaaaaagagaggttattttgaccgctcttttaacgttataaaaaagatatttattattaaaaaggagttcatatgaaaaacctgatttctattcaatctcacgtcgtgtatggttatgcgggtaataaatccgcaacctttccaatgcaactgctcggagtggatgtatgggctttgaataccgtccaattctccaaccatacgcaatatgccaaatggactggtatggtgctacccaaagaacaaatcggcgaaatcgtgcgtggtattgatgaaattggcgaattacatcgctgcgatgcgatcatttctggctatatcggttcagctgatcaagtcgaagaaattgttaatgcggttaactatgttaaacaacgcaatccaaatgcggtttacctctgtgatccagttatgggacatccagataagggttgtatcgtagcagatggtgtaaaagaaggtttggttaaaattgccatgaaagcggcagatattattacaccaaatttagttgaattacgtgaattaagtggtttaactgttgataatttttcccaagcaattgaagcagttaaagtaattctagctcaaggcccaaaaaaagtgttggttaaacatttgagtaaagttggacaagatccgactaaatttgaaatgctactcgccaatcaagaaggcatttggcacattagtcgcccgttacatacttttgctaaagatcccgttggcgtgggcgatttaactgccggattgtttatggcgaatttgttaaacggaaaatccgatattgaagcttttgaacataccgccaatgcagtgaatgaagtgatgcaaataactcatgattctgggctttacgagctacaaattatcgcggctagagaatttatcgttaatccgcgcagccattatcaagcggtaaaaattgcttaatatagcatggatatttttgcaaaatttgagcatatcgttagccaacatcaaccgacacaaacacattttctcgtcggttttagcggtggacttgattccaccgcattgctctctttattgacaaaattctgtcaaaaacgaccgcacttttccctcagtgccatccatattcatcacggtttaagcccaaacgccgatcattggatgacacattgtcaacacctttgtcgccaattgtccgttccactgatcgtggaaaaagtccaagtcgatcgacgtttaggcgttgaagcgggtgctcgcgaagcgcgttaccaagccattcgtcgttatatgcgtgcagatcatattttgacgaccggccatcatcagcaagatcaaacagaaacctttttttctcgcactaaaacgtggcagcggcgtgcaaggcttgtccgctatgccgatgcaaagtgcggtcttttctgtgccgatttttcgcccactgctccaattcacgcgtaccgaactggaagaatatgttaatagcgaaaatttgccttggatcgaagatgaaagcaatcaagataaccgttatgaccgcaacttcttgcgccatcaaattttgccccacttgtgacaacgctgggcgcattttgaccaagccgtacagcgcagcgcgcaacattgcttagaacaacagcaattgttaaacgaattactggcacaagaattacaaaaatatcaaaaaaatgaccacacttttgacattagccaatttgcgcatttttctataccaaaacaaaaagcgttactgcgtttgtggttggccaattgcgatttacccatgccctcaagcaaacaattggcacaaattattcaggatgtgatcttcgcccaagccgatcgttatccagaatttaaattgggcgacaagctgattcgtcgctatcgccagcacttacacatcacaccaatttatcaagatatcagccatcttgttttgccgatatgcttaaaccaatccattgatttactggataatttgggcaaatttataattaaaacgcaatctaatgaatggattgcaaaatggcaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggattgcaaaatggcaagattacatagttctccttccgccaacacaaaaacctatccatcttgcttttcgctattcgggaacggttctccaccatggtattcatcaagacatcaaaaaactgtggcaacaacataacgtcccctattggttacgccaacgcacgcctttaattttttatggcgatcaacttcaatgtgtagtggtacactaatcccgcagtcctcaataagtggtaaaatttaaccaaacatgaggatataaaaatgcgaagacctagaagaacctttagtgcggaatttaaagccgaagcggtaaaattgattaccgagcgtaaatattctattacacaagcttgcaaagagctagacataggtgaaacagcgttgcgtcgctgggtaagccaagttcaagctgaatgtcagggctatgtgttgctgggttcaaagccaatcagtcctgaacaacaacgcattcgagagttagaaaaccgtatcaaagagctggaagaggataaagaaattctaaaaaaggctacggtgattttaatgtctctcgagagcaatgataccaagcggtcacgacgttaaaatcgcacggcattaagcgtttatgtgccttatttggtgtgtcagaaagtgcctattatacgcgtttgaaacggcgacaagcggtcgaaaaacacaccgcacttgcgattgaaatcaaggtcatttttgaggcaagtcgtcaatctgccggcaagcgaactgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgagacaaaagggaattcgagctagtttgcggttgattcgcaacctaatgattcaacagggattatttagcaaacaaccacaaaaatggcataaccgaaataaagaaatagggcaagtttttgctaatcacttgaaccgagaatttacgcctgatgcacaaacgacggtgctttgtggcgatacgacgtacattaaagtcaatggtgtttggtgctatttagcggtagtgattaacctgttaaaccgtcaagttgttggttggaaattgagtcgacaccacgatgcgcaattggttgtcgatgcgttaaatcacgcgatgttgcagactaaacgtacgaaaacaatgctgtttcactcagaccaaggcagtatttatgggagtaagcaatttacccagtgtgtgtaaaaacacaagctaacgcaaagtatgagccgacggggcaactgctgggataatgcaccgatggagcgttggtttagaaattttaaatatgagtggatggcatatggtggttatgttgattttgaaagtgcggtcaacgatgtaaaagattatgtgatgtactacaaccacattcgcccacatagctataatcaaggtttgctcccgatttcagctgaaaaaacttatcggggactgttgaattagttgatcactacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctattacactaaaattgatatcctaaggttgctaaaatatttcttgttttttgatttggcgtaagcgcactctctaatgccagctgagcaaaaaagccattgctaaaatttacttgtgagcttaaacctaaggtcaaaagagatggatttagtctatatgtttgcgtgaagtggctgtttgctatctcgctaaatttggcgttgttacgataatttctaccgcttaatctatgttgatagatcgcatacgaattgaactgaatttgggcattgtctaatgtggttgcatagtttaataaaagccctgcccccatagccgttgagtgataattcacgctgtcgtatgattttgtaaaaatccgaccgctttcattaaatgcattttgatgtacaaaatcatagttgaaataagtcagtggcaatagcgtaacgttttctcgtttataggatttggcaacgcctagctgtgcactcgcaaagcggttttgataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcctgtgatattttctctttctcccacaatctgtttctcgtagtggttttgcgagcccccccaatttataccacttagtagtttgaaatggtcaaaatgcgatacataattcaatgcgacattaaatacctttgaacgagcattcgcagaatggaaagtgcctttgcccctttcataatttaggctcattgcaagctgttgtttattatcgatatttgtcgctacccccatacgcaatccgtgtgaattagctctaaacttatccgcttgggtgatgtgataacttggtgtcaggtagaacatatatttttcctgtgccaaattatttttggctaatttagacaaaaacagatcttcgccacccactaatttttttattccgttggtattgaaacgctgaacaaaatagtttggggttaagctaaacagtagattttgttgagcaaagtgggtggttttgatagtgctgtcgttgagcatatcaggcaaatgatcttcagcaatgctgtttaacacggcttgtctatttgcggtattatccagtttcacaaagaaatcttgatacgcttggctgagttctgtagatgttcttgcagtataaaccgcttcaccgacatcactatttggaatatgaaaagcctcttttttaaccttaacttcagcgataagtgtcccttcttgagcaggtattgcttcagctttttccttctctttttctatgttgttcagctgttctgttgatacggtttcagagctactttcttcttttgccgtatcattaggcttaacttccgtatttggttgttccgttgaagctgtttcagaagtactttcctctgttacgttatcattaggcttaacttccgtatttggttgctccgttgaagctgtttcagaagtgctttcttccgttacgttatcactaggctgagcttctgtgtttagttgctccgttgaagctgcttcagaagagctttcttctttggcggtatcgctaggctgaggttcagtaacaggcttttcttcaatcgtatcatcattaattaccgtgtgatttgaagcgagtttaaaatccgctattttaaattccgttgagccattacttagaatttccacgctctcaaaacgattaaggctatttgctaatgagcctaaatcaatttgcactttctgccctgcggcataaaactgaccgcttaacggacgataaagtaattttccgcctttaatgtcgtaatgttgtgcaactagctttgaatttccttgagtgttgaaatttaacaccagtttagctgtgccgtgatgagtatagttttttccgaccgttaatgtcgcaatatcatcactgccagcaataacagtgcctttattgtctaaattgttggcaatcgtaccgcttccgcttagggtcccgtcttgttccacaaacactgaactttcgctaagtgctgagccactttttagacgtagctctccgccacgcaccaaagttgcccctttatagctgttgctaccacggaaagaaagttgccctaacccttgtttgataaatccaacattcaatcctcgcatttgttctgcaggggaatttttcgctgtggcaagatgtaggctgtcgtcccacattttttgctcgatattgttagcaaattcgccattttgtccttgagtgtcaatcagataataggcttcggttttccctgttgggctttgaatatcacttacatttaggcggtttgcgtcaagtgtcgctacgccgtttaaggctttttgtacatcaagtatgccctgccccattaaatcttcgcgttttaggcgataaagcgttttgttggttaagattttattaagtgtaactttatctttatcaggcgtatcgctatatccaagttccgctatatcttgtctgatttgagcttcgtcttgcggtatatcctgatcaatatagatgacactaaatgcatcatagtttggtttctgtttgataatcaccttaggcaaagtgtaattttgatttgcggtagataacagcacatcggcgatctgtttgccatttaaaaatgggaatttttgagcgacaagagctgctgcaccactaaccatcggcgctgcttggctcgtgccagttaaagggataaattcctcttgtttttctctatttaacttattatgcacatcaaaaagagcatttgccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttattatgcacatcaaaaagagcatttgccgcatcaattttactgccaggagccattagggaataagcctgagagcctaaaaagccgttggaatatttgtggataccttgtaaagtcaaggttctttctccgcctgaatcaagctgatttactcgtttttctttgataataattttgccgtcagaatccacatcaataccatcagcatctaacattcccactgcaataaatgagcgaatatcttcatcataacgaggtaaaagttcaaacaaagacgcactattttttccgtcattgcctgaaccaaacacatttaatactttgcgttctttggcaagtttaacgatccgttctacttcatttttattgtagtaaccactagatccgtctttttccacctcttttaaggcttgttcataactagagatattttgttcataaggaaaaaccttatagccccaactatgattgacgatgtttaattttggatctttactgaaaaaatcaaatagatttaagttccagtagttaaaatttgagctttctttaaacgcagctccataaaattttgcattaggggcaacaccgtaaggatcgccattattttcaaaggttggagttcgacctagatgtctgcctaacaaaatccctgcaacgtgtgtgccgtgtcgaaatgtggcgttatctttttgtgctgaaccgatactacctgcatcatttttataaatatcatcaaaatttttataaccaccgatttcaatggcttttccctgtaagctagggtgttctggattgaataaagaatcaacaacaccaaccaccacattactaccatcaatagcagggttctgctctttggctttttgtaagtttatgatgttatacgatttttcaagggtcacaaaaagatcactggcaaaaaggctagggcttgataacacagcacagcattgcaaaggaaaaagaaactttttcatatgttgtctcctaaaaaatgaatattgttttatgtagggcacactgcgtgtactcgacccaacaaaaatcttaattcgtatcggcggatacctacattcactctgtttcgttatttataatgttgacaatcctactctcaactcacttgaaaacatagaaaagtctgtcaactggctaatacctattaatatttaacatattgtattcgtatattgtgtaatctttttcttgctaaatcaaatattggatgattattctaaaaatttagtcaaaaacaaaaatgacgacattaagacgtaatgatacttatacatctatttgtctactgtggcaggttctgcatctcaatttcgtaacctcataaaaatcgagatgcattgtatctatgttggaaattagaacggctgttattggttaatccgtccttttaagaaatccaacaactgatctttggcaatcatctgtttctcacctgtacggcggtttttatactcaatttctccattttcaagatttttctcaccgatgaccagcatatgtggcacaccgatcagttccatatcggcaaacatcatacctgggcgttctttacggtcgtcgaaaatcacatcaacgccttgtgaacgtaaggttttatacagatcttctgcaaaggtttggacactttcagacttgtgcatattcatcggtacaaccgcaacagtgaacggggcaatcgcatcggtcggccaaataattccgcgttcatcgtggtgctgttcaatggctgcggcaacaacacgagtaacaccgataccataacagcccataatcattgtttgcggacgaccatcttccccttgcactgtcgctttcatcgcttcagaatattttgtgccaagttggaaaatatgccctacttcaataccacgtttgattaacagcgtacctttaccgtccgggcttggatcgccttctaccacattacgcaaatccgcaatttttggtaaagcaacatcacgttcccagttgatattgaagtagtgtttaccgtcaatatttgcccctgcaccaaagtcgctcattaatgccacacttctgtcgataatcactggaattggcatattcacagggcctaacgaaccgatgcccgcaccgattttcgctttaatttctgcttcatcagcaaattcaaacggctccgccacttcttcgcatttcaccgctttgatttcattgagttcgtgatcgccacggatcactaatgccactaacggctgttcttcgcttgcacctttaacaatcaaggttttcaccgttttttcaatcggtagattgaactgttcaacgagttctgcaatggtttttgcatttggcgtatctacaagggtcatctctgccgttggggcttgacgctcgccgacagcaatcgcttctgcaagctcgatatttgccgcataatctgactcggttgagaacaccacatcatcttcaccgctttgagctaacacctgaaattcgtgtgatgccgaaccgccgatagaccccgtgtccgctgcaacaggacggaaatccaagcctaaacgagtgaaaatattgctataggtttggtgcatcacatcgtaggtttcttgaagcgactctttgctggtatggaacgagtaagcgtctttcattaaaaactcacgcccacgcattaccccaaaacgtggacgcacttcatcacggaatttggtttggatttgatatagatttaacggaagttgtttgtatgaactcacttcacgacgcactaaatccgtaatcacctcttcgtgggtcgggcctaatacgaacgggcggtcgccacgatctttaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaactcagggccgtaatcttcccaacgctcagattcaacccataaatccgcaggttgcaccacgggcatttccacttctaaagcaccgcttttattcatctcttcgcgaataatattttccacttttttcaacacacgcaacccggtcggcaaccagttgtacataccagaagcaagtggtcggatcatacctgcacgcaacattagctgatggctaacgacttgagcgtcgttcggggtttctttcaaggttgaaaagagatattgacttgtacgcatttatttatcctatttgtatcaattctataaaacgaaatgggcggtattttaaatcaaaaagcggttagatcgacaaagaattttgcaaattgtaaaaaaatcctcatatctggccgcttgttttaggtaattttagagaaatgccgattcgatcaaaaatccactatggataatccctgagcataatgttagaattacccaaatttttcgctaaccgatagcgaaacttagttctggtgttgtggaaaataaaggctggtttgacttgtattaaaacgcttgaatttagcaaattttcctttacactattcaactctcgcacttagcgaatttatacacataggaaacaaaaaatgagcattgaagaacgcgtaaaaaaaattatcgttgatcaacttggtgcaaaagcagaagatgtaaaaccagaaacttctttcattgaagatttaggtgcagactctcttgacactgttgagttagtgatggctttagaagaagaattcgatatcgaaattccagatgaagaagcagaaaaaatcgctactgttcaatctgcgattgattacgttcaaaacaatcaataatctccatttagaaaaagcgacttttacaagtcgcttttttttctgcctcttattttttttctctaaatatatccgttcttaaattgcaaagctaaaccgttttagctactatgcacaagattatttttagactttgaaaggttaatttatgagcagaatttgggtgttaggtgatgccgttgtcgatttaattccggatggcgacaatcattatttgcgttgtgctggcggtgcgccagcgaatgttgcagtcggtgtttctcgtttaggggttgaggctggatttatcgggcgtgtgggcaatgacccactgggtaagtttatgcaacaaaccttgcaagcagaaaagatttcaaccgagcagatgatacttgatccacaacaacgtacttccacagtaatcgttggtttagatcaaggtgagcgtagttttacctttatggtcaatccgagtgcagatcagttcttagaggtcaatgatctgccaaatttccaacagggcgaatggttacactgctgttcgattgcgttaatcaatgatccttcacgttctactacgattgaagctattcgtcgtgtcaaacaagcgggcgggtttgtgtcgtttgatccaaatttgcgtgaatcactttggtcaagccttgatgaaatgaaaaaagtggtgaatagtgtcgtggcaatggcagacgtgttgaaattctctgaagaagaattgaccttattgactaatacgacaaatcttgaggatgcaacgaaagcggttacttcactttatccagagaagctgattattatcactttaggtaaagatggggcgatttatcacttaaacggtaagagccaagttgttgccagtaaagccttaaaaccagtagataccactggggctggcgatgcctttgtgagcggtttgttagctggtttatcgcaagtgtcaaactggaaagagagtgatgcggtattagttgaagtgatccgcaaggcgaatgcgtctggtgctttagcaacaacagcaaaaggggctatgtctgctctgccaaataaggctgagttagaggcgtttttaaaataatcgatttgattctcctattgtacaacccaaatataatttacctttactgggttgtacccccaaaaggtaggcgaagatatgatgaagagccattcttacaaacctttagcaaaggtctaatgtgccaataatgcaggagctttcttttggctcttcccccactacaacagcgatatatatttcaaaatccctttaattttttgtgaatcggcaatgtctaacacattatcctgtgatgaagttcccattcttgccgaacttattgaatccattagactttgacgttgccctttggctgaaaaatgaatttcaggcaccttggtttgttcaatgatttgtttaacattatctgcattgaccccacagccagccattacttgaatacgcccattcgcttgtttgactaactgctgaataacaggaatcccatcaaaagcagttgcagcctgtcctgatgtcaaaatacgatgacaacctaagtcgataagttgttcaagagcagtaatgggatctttacagagatcaaaggctctgtgaaaggtgatctccataccttgtgaagccttaactaatagttctgttgttgctaaatcaatctcaccatttgcagataacgccccaaaaacgaccgcttgtatgccaagctgcttggcagttgcaatatcgttgagcattatctgaatttcatcttcgctatacagaaaatcacccgcacgaggacggatcatcaaggctaggggaatagtcgaaatttgttgagcctgctgaataaagccgagatttggtgttaagccaccaaccgcaagggcagaacataactcaatacggtcaatcggaaattgatttgcggtgatgaccgactctagattatcgacacagatctcaactttcatttattcccccacgataaagcgataatgaatgtgatgttgataaggctcgtttgctttgctgattccgccatagtgccaccattcagggtggtttggggtatcagggaaaaactcaggttctagagcgacccctgcataatcaggatagcttccgctcgtcaaattaggctgtccgcccagccagttccctgtataaacttgcaatgctggtttggaggtacgaagttcaaggcgaagattatcatacgctaaaacagcatcagcctgacaagcggtcagatcttggcaagattttgcaagtaaaaaggcgtggtcataacctttaacagcttgttgatcggtatcagccagtaaatcttgaccgatcatttttgccgtgcggaaatcaaaacttgtaccttcaacagcttttaatggggcgttcggaatgccattagcaccgacaggaaggtatttctccgcactgagttgtaggctatgttgatgaatggtcggttcattagaaagattgaaataggcgtggttggtgaagcagagcggtgtatcttgagagcttaccgcattaaattcaatctcaagttgattaccgttcaaacgataaacgacagttgctgttacttcaccgccaaagccttcttcaccattggcgaaaattttatgaaaagtaaccgcttgttcatctaccgattgcacctgccacacacatttatccgccccgatttccccaccgtgcaaattattttccccgttattttttgccaaaataaacttttgcccattaagctcaaaggtgccatttgcaatgcggttggcataacgccctaccgttgcaccgaaataagctgattgctcttgccaacgttcaggcgtggtggttactaatacttctcgttgttcatttagcaatttaactacgcaagaaagccaagatgcaccaaagtcagataggatgattttgagatgatcgttttcaagggtataaattttcatatttgctctctttatgttgcttcccctctcccgcaagcgggcgagagaaatgatattatgactgcataatttaaaccactctcaccccatcacttgctgtgcaaacatagaaagtttcttgaatgccagtttgtttttcgtagttttctgcgatgagtttacgcaacgcttccactttttcatttggaaccaagcagacaatacaaccgccgaagccaccgcctgtcattcttgcaccgccatttttgccgatagcgacttgagctaattcaactaaatagtcaatttctgggatagtgatttcaaaatcatcacgcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaaggcttcaaccgcttctagtacacgatgattttcgctgataacgtgttttgcacgtttgtaggctaattcattaagctgttgtaactctgccgctcgctcaataaattgttcagggctaacatctcttaaggctttaacgccaaagaattgtgccgcaaattcacactcttgacggcgactgttatattcccctgtgactaaatcgtgtttgacgttagagttaatgatcgcaatgaaatagccttgtggcacgggggttgggctaatgtctaaactacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgggctaatgtctaaactacgacagtcgatcatcacaaggtgatctttttgtcctaatgccgaagtaagttgatccatattgccacaatttgcaccgacaaatttattctcggcacgttgtccgattagggcgatctccgctagactaatcggtaaattacctaacacttggcaagttttaccgatagaaatttcaagagcagcggacgaacttaaccctgaagacatcggcacatcactggtcattgcaatatcagccccttgaataaattcagggcaacgctcttgaatatatttcaccacgccacgcacatagtttttccatttatcttcactttgtggaatttcttttttaatatcaaaggcatcggtttcgttaatatcaatcgcatagacacgccaaatggagtcgtcacgtttcgcaaaactcacggacataccgtagttgatcgcacaaggcatcacaaagccatcgttataatcggtatgttcaccgataatattcacacgacctggagcaaaaacggtttgctgtgacgcataaccaaaatgttgttcaaattgagtttgagagagttggattgggggcattgttatcttccttcttaatttgttatttcggggcgggcacatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctacaccacgcaacaatttgtccgtctaattcataaacctaaatcggatatttagcatgatttagattgctgattaaaccacgtttggcgactttccttcgttgctggaactaaatctgccgtcactgtgcgtctttcaatcacctggttataaatttcaagaattcgagttaaatcatcttgttgtgctaggcggaacatctctatccttaaacttgctcggtacttaactgccaacctagttggcgatattgtttataacgttccctcgcttggaccttttctgtttcatcaaccgacacgaaatcaataatttgattgaagctgttaataaaattgggtaattctgtttgtaatgaaatcaatacatctcggcgttgggcattgcgtttgcctttccacgaaatttcaatcggggtcgcataggtggtgacttcgccggacagattatgtggtacaaaatcatccgcttctcttgcccaaagtgcttcatcaaggttgaatgcctgttcttcggtttcacaagcaatcagcactcgcttaccttgtcgccacgcttttgccgctaaatcgcacgctagagcttcttgggcggagagttcgcctgcttggacttggcttaatagatagaattgtacttgcttcactgacatactcttagaaatatagttagacgaattataacttatatttatcataaaacagatgtttgaaaatattcaaactacatttaatgcaatgtaaattgaaatttaagttaatgaacgttcattatacatctcctcaatctgctcccgatagcgttgcataatcactttacgacgtaatttcagcgtcggggtgatttcttccattgccgtactaaaagcctgaggcaagagagtaaatttcttcacctgctcaaagctcgggagttctttttgcaactcgtggatacgtctttcaaacatctgaataatgtcggaatgtttaatcagctcgatcctatcctgatatttgatattaagttgctttgcatattcctcaaggctatcaaaacacggtacaatcaaggcagaaacatacttcttcgcatctgcaatcacggcaatctgctcaataaacttgtctttaccgattttgccctcaatgtattgcggagcgatatatttcccatttgaagttttcatcagctctttcaagcggtcagtaatgaataaatttccgcaactatccatttcgccaacatcacccgtgcgtaagaaaccatcttcggtaaaagcctttgccgtttcttcaggcttcttatagtagcctcgcattaccattccaccacgcaccagaatttcattttcctcaccgattttgacttccgcatttggcattaatgtcccgatagaatttggattaaagcccttatcttgccagcaagaaaccgttgcagtcgtttcagtcattccatagcccaatttaatgttgatcccaatactgtggaaaaatgaaccaatagaggcttccaactttgctccaccgcaaggcatcattttgatcctaccgcctaataaagcacgcagtttagtcagcactaatttgtctgccaaagcatattgcaaacgaagccactgtgagggttgctctgcttgataatgctgttcaccaacacaaattgcccagttgaacaaagctcggcgatgtgccagggctttttccactttatcccataccgccgtataaattttttcatagaaacgaggcaccgcacacatcaccgttggtttcagtgtagtcaaggcatcacggacgtggttggtgtcttccaagtagcaatttgtcgcaccacgatgaaaaacataagcaacccacgcacgctcaaaaatatgcgaaagcggtaggaacgaaagcgacacatcatcttcattcacatttaaggcaagatcgtgagcatttaattgatgggcaaggttagcataatccagcatcacaccttttggctcacccgttgttccagacgtataaatcagcgtaaaaagatcggacaactgtttagaattaaggcgtttctcaaattccgcttcatttggaacaacatctagaaaatcttcccaataacacgcatttggcagatccctcaaatccatattcgccttcattgccacaattttcattaattgtggacagttgttcgctatttgacagacctgatcaagttgttcttgatcaccgacaaagagaattttaatgtcagcgtcattcacaatatattccacttgtttagccgtgtttgtcgcataaatcggcacagcaaccgcccttgcctgcattgccccaaaatcagcaatagtccaacgaggcatattatttgcaaaaataccgattttatcttggatatcaatatgttgagcaattaaagcataagagaaacggtcaatttcctgttgaaaagtttgccacgacatttcctgccattgagcttgttcacggaaacgcaaagcggtacgattaagccatttttttgcttgcaggcgaaatctattcacaaaatggaagtcgagagaagccatctttttatcctgtttattcagcttacaaatgttcgctaatatacttttttcattgagaaaaagctagagaaatgtgaacaaatgtaagctgaaatatcgcctgtctgtattcttaagtaatcgtaatctgtgccttttgtatcattgactgccttgctgcatctgccacttttacaccaaatggacaacaggcttatcttcaggcaatgtgccagatatgagtacggctttactaaatcacgtcattgaaatgattaatttcggtgcattgcaaccgataggcgatctaattgtagtgcaatttatgaaggtacagttaaagggcaaaattattctattccgctctattctcacgctcaagtgatgtgggtacgcaaagatttgttagccgcaaataatttaagcgtaccgaaaacgtgggacgaactttaccataccgcaaaagcattgacgaaagatggagtgtatgggctttctgttccaatgggaagtaacgatttaatggcaactcgctttttaaatctttatgtgagaagtgcaggggaaagtttattaaccaaagatcttaaagtgaacttaaccagccgctcttacaaacctataaaatcctataaatagctgtaaaaagctataaatatagcgatttctgttgtattcctgtttcaaccttgctggttacaagcgacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctgataaggagctttccttatgtattaccgtcgcaataactatactagatggatattcgtatgacctgcgttgttgatcgtttcggtactctttgtatatccgtttctctcaagtatcttttatagtttaccaataaaaacttgattatgccgacatatagctttgtaggattagccaactataaagcggtgttgtcagatcctcgcttttggatgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttggtcattcattaatgtggacagccttatctctgataggtcaggtgttagtcggtttcttacttgcattggctttaaatcgggtggaacgttttaaatggctttataaaatcctgttaattgtaccttgggcattcccgatgattgttatcgcattttcttggcaatggattttaaacggtgtttatgactatttaccgaatatgttggtgcagttagggctgatggatattgcccctaattttctcgctgatcgcacttgggcattcgtttgtctagtctttatcaacatttggtttggtgcccctttaataatggtcaatattctgtccgcattacagactattccgtccgatcaatatgaagcagccaaaattgatggagcaaatatgtggcaagtgttccgttatatcaccctaccgcatattaaagtcgttgttggattactagtcgtattgcgtaccatctgggtatttaataacttcgatattatttatcttattacaggtggcggtcctgctgatgcaacgatgacattaccaatctatgcctatgatatggggtggggaagtaaattattagggcgttcttctgcagtgactgtattgctctttatcttcttactgtcagtttgtttcatctacttcaaaattattaaccgttgggaaaaggagagtaaataaaatgaaaaagaaatcttcattacttggcgacatcgtttcccatcttttcttagctacttcaacggtcattgctatctttcctttggtatggatattcatttcgtccgtaaaaagtaaaggggaactcaccagtgaaccaactcggttttgaccaaagatattcacactagattactttgaacacgttattaacgatctcaatttcattgtaaatattaaaaacagcctatttatctcgctagttacgaccattatcgctatcaccatttcggcaatggcagcatacggtattgttcgtttcttcccgaaattaggctcgataatgtcaagactgttggtcacaacctatattttcccaccgattttgcttgctattccatactctattgcaatggcaaaagcagggctaaccaatacaacaagcggtctgatcatcgtctatctttccttcagcgtaccttatgcagtttggttgctagtcggattttcccagacggtaccgattgaaattgaagaagccgccaaaattgacggagcagggaaattcactattttcttcaaagttgtattaccgcttgttgcaccaggtattgttgcaactgccatttacacctttatcaatgcgtggaatgagttcttatatgcccttattctcgtcaacgatactagcaaaatgacagttgccgttgcattacgatctctaaatggtgcagagatcctagattggggcgatatgatggcggcttcagttattgtggccattccatcagtattattcttttgttttattcaaaataaaatcgcaggaggattatctgaaggctcagttaaataaagtttcatcgctatcggtaaaggtaaattctgtattttaattaatttaggagacaaaaaatgattagatatggtgttgttggcgtgggctattttggtgcagatctcgcgccctttatgaatgaatttgataatgcacaaattacggcggtttacgacccagaaaacggacaaaccatcgcagaagaattgaaatgtgatgcagcaaacagtttggaagaattggtaatgcgtaatgatgtagattgtgtcattgtcgcaacgcccctgagtttggtgatgaagacgatatgttatttgtcaatttggaatttgatgataaccgctttgctgtattggaatggggatcagccttccgttggggcgaacattatgtgctaattcaaggcaccaaaggggcaatcaagctggatatgtatcattgcaaaggcatattacgccttgatggcaaagagagttatttcttggtccacgaaagccaagaagatgatgatagaacgcgtatttataccagtactgaaatggacggtgcaatccaatacggtaaaccaggaaaacgcaccccaatgtggctaagttccattatgaaaaaaagagatgaaatatctgaacgatattttacacggtatgcaaccaagtgaagaatttataaaactactcacgggcgaagccgcaagagctgctattgcaaccgcagatgcgtgtacgctttcagtaaaggaaaaacgtcgggttgaattaagtgaaattattcattaaataatggaaattaaaaccgcactttgaaaaagatagtgtcgtaaagtgttcataagttttggtataacggtaaattatacttgcttatgaacacttttatttagcgagttttgagagaatagcttgtttgtacttccaaagagtagtgaaacaccgcttctattcaaccggagccacttcctcaatcggagcttgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagaagttgtcaagcaagcactgacattcctcgaataaattaataccatgtagctgttagcaaaagtaatttctgtactatctaacagctacatgataataccaacaaaactacatattctctaactcttccaactcatccgccattgcacttaatgcatctcgagtaagttgggctaatgctttataaaaacctgtatcaaaggcttccactttgcctaagaacttgcttaaacaaggtaaaacaaaatgttcaaagaaatcacgttgagcctcagtagaatcaaggttatcttcaatccaagaggctgttagcagtagcaatgcaacgtgatcgggatttgctaattcaggcatacctctttgctggcggaaagccacaaagtcagcaacagataatccataggcagagattgttgtagcaatagctccattttccgcaaaaagtgcttgataactgtccgcttgttccgtagggttagcatttttttctatgattgttagggcaagttcactctgttcatcagttgccaatgcccaagtttgacgaagattaccctgttttagccacgcaaaagtccctgctaaaataggatctgttgggttgcgataaaagagattgccgaacaaacggcacagtagagaaaagtcgttgatcgttgtttggttcataaaatcagtttccgtaaaaatgaaagcggtatgttacatgaattatttggagaaaataagatgaaatatattggtgctcacgttagtgcttctggtggtgttgaaaatgctgtattacgctcagtcgaaattggagcgaatgcctttgctttgtttacgaaaaatcaacgtcaatggcaagcaccgcccttaaaagcggatactattgaaaaatttaaacgtttttgccaagtccaccatttttcgccagcacaaattcttccgcacgatagctatttgattaatttaggcaatcccgaagcggaaaatttggcaaaatcacgcgaagcctttattgatgaaatgcgacgttgcgatcaattagggctaaccttgttaaatttccacccaggtagtcatctaaataaaatatcggaacaggattgtttagcgcgtattgccgaatcgattaacattgcagttgatagtgtgcctaatgtggtggcagtgattgaaaatacggctgggcaaggctcaaatttggggtggcggtttgaacatttagctgaaatcattgagcaagttgaaaataaacagcgtgttggcgtttgcctagacacttgccacttattttcggctggttacgacatcagttcattagcctcttgtgaacaaacttttgctgatttcgataaagtggtcggttttgaatttttgcgaggtatgcacttaaatggctccaaaacactgcttgcaagccgagtagatcgccatcacacgttaagagaaggcacaattgggacagatgtctttaaatttattatgaataatgctcattttgacaatattccgctcattttagaaacaatcgaacctgaaatttgggctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaacctgaaatttgggctgaagagataaattttctacgttctttggaacaaaattaagttatactggtctgatgtgataggttttgtgcagaacaaaacctttgttttatacaaattactttaatttttagctgaggtagttcgcttttctagttctggcgagacaaatttattatgcaaaaatcattattttctttaaccaaaaccgttcttttttctctgaccattgcgttgtctgttgggtatagttcaaacgctgtcgcaagtttgagtaccaaacctgcaaccccaacgcaattaagtaaagcaaaaacaacggcaaaatttgcctcagccaaaaaacaagatgtgacacagaaagtaatggatgtctatcgtcaatgggctggaactcgctaccgtttaggcggtgaaagcaaagcaggtattgattgttctgcttttgtacaagctattatgggttctgcctttaaccaacacttcccacgttcaacggcagaacagcgatatatggggaaatccatctctaaatcagaattacgtccaggtgatttagtctttttccgtaaaaataatcacgttggtgtttatatcggtaatggaaaattcgttcacgcaagttcaagccaaggtgtaaccacaagttctatgtccgagagatattgggctaaaagctatacccaatctcgtcgagtgttttagattccatcctgtatgtttttagctgaaatgctatttcttatcggtataccttttgagcaatggccacttaaataaccagattgaaataaaagtaacaagtccatttcatcatgggtatagtatgtcaatacaaatcaaagtctactataaatttacttgataaataatgaaatttattcaataatggaggtgcactttttagttagctgtataaacctaatttagtgctttcatttattaaaaacaaggggagccattttcggcgttattacccacacaagaggaaactttaaaaatggcaaaaaaagtccaagcctacgttaaactgcaagttgcagcgggtatggctaacccatcaccaccagttggtccagcattaggtcaacaaggtgttaacattatggaattctgtaaagcattcaacgctcgtactgagagcttagaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttaccaattccggttgttatcacagtttacgcagaccgttcattcactttcgtaactaaaactccaccagctgcagtgttattgaaaaaagcacttggcttaaaatctggttcaagcaaaccaaacaaagataaagtgggtacagtaactcaagcacaattacgtcaaatcgctgaaactaaagcagcagatatgactggtgctactatcgaaaccaaaatgaaatcaatcgctggtacagctcgttcaatgggcttaatcgtagaggaataatacaatggctaaattgactaaaaaaatgaaagcaattaaagctggtgtagattctactaaagcttatgagatcaacgaagcaatcgcagtgttaaaacaattcgcgacagctaaattcgttgagagcgtggatgttgcggtaaacttaggtatcgaccctcgtaaatcagaccaaaacgtgcgtggtgcaacagtattaccacacggtacaggtcgtacagctcgcgtagcagtatttactcaaggtgcaaacgcagaagcagcaaaagcagcgggtgcagacttagtgggtatggaagatcttgcagagcaaatcaagaaaggcgaaatgaactttgatgttgttatcgcttctccagatgcaatgcgtgttgtaggtcaattaggtcaagtattaggtccacgcggcttaatgccaaacccgaaagttggtacagtaactccaaacgtagcagaagcagttaaaaatgctaaatctggtcagatccgttaccgtaacgacaaaaatggtattatccatactacaatcggtaaagcagacttctctccagagcaattaaaagagaaccttcaagcgttattagcggcattagtgaaagctaaaccgacaacagcgaaaggtatctttattaagaaagtaagcatctctaccactatgggtgctggtgtagctgtggatcaagcttcactataatttcttatagatagattaaaagccgcttaaagttcatgctttatgcggcttttaatttttgcttaccacgcttttccctcaaaaccctccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcgatccgctcgctgattaaatccatcgtctgatcgttaagcaacagctgaatattcaacttcgggtgtaactgcaaaaagcgattgaccatttgcactaaatgatacgccccgaaagtttggctactggtgacacgcaacgcaccacgcaattcaccctgctgtgccatcatttcttgttccatctctgcggttaagtttgcaattctttggcaaaaaagcaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcacaaactttcagtccatatatcctattaatcactcgtgtgttagtcggttatatgtttttacttcatggcaccgcaaaattctttgagttaccgatttcaatgacaggcggcaatggtgcggtaccactcttttctctgtttggtgtagcaggtgtattagagattgttggcggtatcttgttgattttaggtttatttacccgtgcaacagcatttattctagcaggacaaatggcagtagtctattttatattccacgctgcttcaggggcgattttggatccaattagtaacaaaggtgaagctgctgcattatttagtatggcattcttattattgtggcatagtggtgcaggtaaattatctcttgatgcgaaattaggaaaataataggggctgtcctagataacgactaaaatagagcttttagtcgttatctaggacagccccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttatcttagcattctatcccaaaaactatctaatttccaattttgtgggatatccatatattctttttgaatctagtctgatggtataaagcaaggcttgggtagcaactaaaattggatatttaattgttggaaaggaatagtataagctgaaaaacgataatagctgatatgttctaaatagcgctttgaacaagcttcatcagggatttctttccattgttgtaaaagttctctgtttgattttgcaggtttgttgaattgatttatactccatcttccgcataaaaaactgcaaggttgtgcgtaactaagaaacttattcatagatatagcagatatatttttgagcatggtagaacaaactaaagatttcacaactctagttttatgtaacaaacgataaaatttgaagaacatggtacgaattaaccttttatccagatagcacaaatgcccatacttacactatctttttccccacctcttgtgtattttgcaaaattttcccaaatcccaccgcttgtaatttatccttattaccactaaattttcttgcattcccccctaattagcctacaatccgcatcgcctgaatggctaagtttttatgcgactttggtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatggttttatcggcggtcacattggcatttgcaagccatcaagcagtagcaaaaggcgataccgcctatctctatacttggtctgaatacgtacctgaaggtttgcttgatgattttaccaagcaaacagggcttaaggtgatcgtttctagccttgaatcaatcgaaacaatgtatgctaagctaaaaacaatgggtatgatgtgattgcacctacaagttatttcgtttcaaaaatggctcattaattgaacggatggcataaatgaaaatttatgccactttttatactttaaataggtaatgttatttcataaattattaggagaagatcaagtttaataaactttcaaagatgaataaactttattttatttatacttatttaagtgcttcattaatgatttggattttttatctttttctggcaataaacaatatttccttgttttggttttttgacgctataatttcttttttatcatggttattaatgggagctgcattaacctatagctattctttatcaagatttctttcgcataaacatcgagaaaagatcaccatattctgctttcttatttttcttttgttttgtatttataaagaaattatgccaattcaggatgatatttatgtgaaagtatttaacggtattcgagagttttttatgctgatgaatgcggtttattttggtactctgctattaaaggtatttaaggtgaattatatgaataaccagaataaaatatctaagatatgggattaatgtatcacaagcgctttatttctataaaaactttgcaagttaaatttaatcggtatagtagacaaaatagttgctaaaaagtgatttgaagccttatagcacaaggatttaggtctcctttttgatatgtgaatgaaaaattgtccattttgctaaagcccggaaaaattgagtaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaaaatgaatttaaggtaacaacgctagccccaattctttcaaaaatacattatgtttagctgttgcaactttgatttttgcatccaaatccatcaatacctgatgattggcggctaaatcaatttcttcttcaacagcggtattattaacatagcgggcgatgtttaggttgtagtcgttatcttcaatttcctgcacggaaatgcgtttggcatagccttgtgtttctttgcgatattgataatgttcgataatttttgcgatatgctcgtcagtcaaacggttttgacgtttgcctttttcaaaggcatcagctgcgttgataaataaaatatcgtcttcttttttgcattttttcaacaccaaaatacagacgggaatccctgtagaataaaacaaattggccggcaatccgataaccgcgtctatatttccatcgttcagcaatttcttacggattttttcctccgcccctccacggaacaatacaccatgcggcaaaataatagccattgtgccgttatcacttaaaaagtggaatccgtgcaataaaaaggcaaaatctgcagctgatttgggagcaagcccatagccgttgaagcggaaatcattggccaaatcttctttgggatcccagcggtagctgaacggcggattggcgacaacggcatcgaattccagttttcttgcaggattcatttcattcagaatatcccaatcattgattaaagaatcaccatgatgaatggcaaattccgtatccttcaccccgtgtaacagcatattcattctagccaggttgtaagtggtgatatttttttcctgtccgtagattttgccgatatgtccgccgttttccgccatttgatgacgcacattgagcagcaatgaaccagaaccgcaggcaaaatccagcacgctatccagttttttcttcttaccgctggcggggttttggctatccagcgttacgatttgcgataaaatagtggaaacttgttgcggcgtataaaattcgcctgcttttttacctgaaccagaagcaaattgggcaatcagatattcataggcatcacccaaagcatcgctgtcggcagaaaattcactgataccttcagcaatacgtttgacaatttcagccaatttgttgttgcgctccgtatagctttttcccaacttttccgaattcagattgatttcggaaaacagcccgccaaacgtgctctcaaaagattcgttttcgatatatttaaaaccctgttgtaaggtgcttaacaactcagtgctctgcactcttgccaattcggcaatactgccccacaaatattcaggcttaatcacataatgcactttgcgtcgcatttgcttttcaaaatcggcggtaaagtcagcattttcttgataccataccaccaaaggcgtgcgcttatcatcattgcttaattgcggataatccctacccagctctttttgcgcagcaagttcgtaattatctgataaatagcgtaaaaacaagaacgatagcatgtaatcacgaaaatcgtcggcattcatcgctccgcgtaattggtcggcaataccccataaggttttgcctagttgattgagttgttcttgggtcatggttgtgtctctttaaatgaatcagggtataaatctgcgtgaaatggataggtttttccccgtaccgttatgggcaaaaattaactggcatttgctgttttgtgttcgcagccgccttgccagatcctgtaggtcagttaaattttcaaatgaatcattattttgttgattatttcgaggcatatttggtttctctattattgttgctctcactgttctcatcgctttgtaatacggtagaaataacggattacttatttactgtatcgttggaaataactgctgcatcaagcctttcttatgggttttcagacggcctatccgttcgttttgttcgttaattagattatccagtgaagacaggcaatctgcgatggcttgttgttctttaggtattagcattggtaaaggcatagacatgaaatcattatttgtaatattcatacgatcgtatctagccccactatttgaattttgctgtaaatacttgtgccaagtattggttttaaaaaaatactcataaaaatcgttttgttcatttttaaatctaaaaactgtataaagtggtgacattacaccaataccaactttatttttagaaataggacccacaggagctaaatttgaaatccttggattataaacataatctccaaattcaataatgtaatacccatcgagattattcttattggctatatctctatcaaaataatccccttgatcaattacaccatcatttgcagaattagttagaacacgaataatagcgttatctttatttttaaccgtaactctattagctaacacttttaattcaacaacctcccaccccttacaatttctaaattgcggaaatctaagtttcggataaactatcttgcttgcttgcttgcttgcttgcttgcttgcttgcttgcttgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgcttgcttgcttgcttgcttgcttgcttgcttgcttgcttgcaaatcattatggcttgggaataattgctgcatcaagccttttttatgctgttttaaggcggcaagtttttgttcctgcaattcgattaattcatcaagtgaagaaaggcagtcggcaattttttgttgttcttcgaatgatggaattaaaacatttacctcattaaaaaattcttgaatcccaatattcaacaatccatgatttcttgcaccttcttgggctactttcccaatatcattattttgaacaccagcttcaaaatagtgttcaaaaaaattaccatagtttgaataactttcctttagtttgaaacagatatataaggttgaaactacacctttatcatatagcttcaatggctttatagccccataaggatatccatttgaatagcttttattgtatgcaaaatctcctttatgtagtaaatagtatcctgtaatatctttggctgagacagatttattaaaaaaatccaactgactaattaatccatattgagctgaaattgttagtacattttgattattttctttattttttagcgtaattcgattaaaaactgttgataagggacgattttcccactccaatgccgtctgaaactcaggaaaacgaagtttaggaagcactctttcttgttggttttgcttattctgttctgaagcattcattttttatactcttggatttgtatattgcttaggcaaccagccgttctacaacttggttacgttctgtccataaaatcggttcgatatcgtaatttcttagtgcgtcaatcgccgaagctgcgacttccgtttcgctattattgagcaaaacaaataattcggaattgaccgcacggttttcacgactatccgtccatttgaaaaccgtcgcttcgatggcattttttttcgggttgccgagcgtttgtaagatacgttcgggttgtttgcgcgatttggggatgacaaagtcaaacatatggtcaaagccgcttttgccggtaaatttgatattgggggtatagcgtatatccgagtgatccagccattgcaccacatcttcataaaacaggttggcaacgtagggcgaagccaaataaaacaggtcgttaaccgccagcatggcttgcaggaaattatgttttttcaaggcgaaattttcggcgctggctttgagtatcaaggtttcgccgtcgagctgaacgccgaatcctgccaaagtcatttttaataatgctttgcgtttttcgctatccaaagaacagccggaactgattaaatcgtgaatgatatagccatcatcactgagcaaaaaaccgttggcttctttgcggatataaaattgcaaacagtcgttatgacgatccaaatgcggagtggtaacctgcacccaatctttatcgatttgttttaaagccgttttgtctttcaaccattggagatattgctccatcaggctttgtatttcatcaatcatatgaataattctctttgaattaagggcttgccgataatatggcaataatccataaatctatccagtagatcataagggctgtctaacactaatttgagttcatcaggcagcggataagcccatttgtcgccgtagccttcccggtagaggtgaatatgcgggcaaataatttcttcaccatcgggattgcggtgcggcgggccttcaatatccaggcgaaccaatacaatggcttttctggcccgggtttggaaggtgattttttccaatgcgatataccctctggttacatccaagttaaaagtttcttttttatccattgagtgtaacgacaagcgtaatgaaccgcccatatagggaaatttgtattctccattgctgaaatcatatttttccaatgtcaataatgcatctgcctcttgctgtgccagcatgttatttatccttagatcgtttattcatacgccttcaagcctgaaatttcttttccttttgccatatttttcagcaagggaacgaggtcttccattaaggctaattctttaatacgccgttctttccagcttaattccaaaggttcgagcaggtcggtgagcttttcaccatcgaaaatcatgcggtttaggatttcttcgataaagcctctcaaagtatcggttgcaatgccgtgtttttgcgcaagtgcggtcagttttgcgtttgtttttgcgtttctgaatgcctgatagccggctttaacttcttgctcgttgagtgcttcgcccgctttcaggctgtctatataggcaatgatgtcgtctttttcatccatcaaatcgctgcttgcggcaactagttctactaattgcgtgcggctcatctgctgttttttcggtttggatgagttttcagcaatcagtttcatgatgtagtcgtaatcgatggttacggatgaaaacaacacaaattcaaagtctaattgctcaagctccggcgatggtggcgtttttccatataacgcttgttctttgatttgttgcgccatatccagatacacgcccttaaaagcgcgctgggtatcgcttggcaaaatattttcaattgcctgcttttgctcttcgcttaaatcggtatattgccccaactgggttttgtaacgctgcacttctttaaacagattgataaatccggcacgggcgttgtcgcctttcaggttatgtgcttcagacggcgtacaggtcaatccctgtgatgacatgaaatcttccagttgcgtcatggcgttttgcagtttggtcatgacgatttccgccggatcaacaatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccctgaaaaacgcttgatggcttcgtctacttgcgcctgctgcccacggaaatccaagatattaccgtagggtttggcagaatttaatacgcggttggtgcgggaaaacgcttgaattaacccgtgatatttcagatttttgtctacataaagggtatttaaatatttgctgtcgaaccctgtaagcagcatatcgacaacaatagtgatgtcgattttgttgcggtgcggatagtctttatcggggtattggtggtctttaatccgtttttgcacatcttggtaatatagatcaaattcgccgatactgtgattggtgcggtattgtgcattgtagtcatcaataatggcttttaaggcggctttcttgccgttcggatcatctttattgtcttgttcctcctgaggcaaatcggcttggatttgggctatatcttgattgccttcggcgggcggggaaaacacgcaggcgatattaagcggcacgaaatcgggattatccgcctgaaacttggtttgtgcttcttttaaaatgcggtaatagtcaatcgcatcattaatggatgcggtagcaaaaatagcattgaaacgacgttcggaagtggccacatcgtgtttgcttaaaacggagtccacaatcgcctgcttggtaacgggatgattggcagatacgggcttacctccctccgccttgtaataatcaatatggaatttcaatacattaccgtcgtcaatggcattggtaatggtgtaagcgtgtaattgctgttcaaaaatatcttcggtggtctgatagaacgcatctgtgccgtcgatacgcttgtatgttgcgttttcttcaaaaatcggcgtaccggtaaaaccaaataattgtgcttttgggaaaaatttcttgattgcctgatgattttctccaaattgggagcgatggcattcgtcaaaaataaaaaccattcgtttatctttgagtgtgcttaattgtctatggtgggtactattttctttgagtgccaaccccagcttttgaatggtagttacgataactttatcggcgtaatcattcgaaagtaggcggttgactaaagtagaagtattggtattttcttctaccgaaccttcttgaaagcggttaaattcttcacgtgtttgacggtctaggtcttttctgtctactacaaacaagcatttatcaatatcgggattatttttgagtaatgtggaggctttgaatgaagtgagtgttttgcctgaacctgtggtatgccaaatatagccgttacctcggttttggtgaatacagtccacaatcgctttgacggcatagatctgatacggtctcatcatcaaaagcttttgttcgcttgctaccaacaccatataatggctgatcattttgcctaacgtgcatttttccaaaaatttatcggcaaaatcatacaagtaattaattttattgtttgcttcatcggcaagacggtataccggtaaaaaacgttcgtctgcatgaaaagcgaaatgtttgttttgattgttggcaaagtaataggtactactctcattgctgacaataaacaattgcataaaacacagtaaactgttgccgtagccgttgcctgtgtcatttttataatcgatgatttgctcaatggctttttggggtggaatttgcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttcagctcaatttgaacaacaggtataccgttaatcaataaaatcacatcgtagcggtgatggctgttttccgtgttgatacgcaactggctgatcacttcgtagtcgtttttgcaccaatctttgatatttaccagcgtataattgagcggtgtgtcatcttcgcggataaaggtgctagtttcacgcagtctcttagcagcggcaaagacatccggtgtgataatttcaagctttaagcgctcaaattcgctatcggttaaacgaacgcggtttaactgttcaaatttctcacgaaaattttcctccagtgattgtctgtcacaaatatcttctcgaaaaatatactttaaatcttgtaatttctttattagtttattttcgataatggattcagcatagttcatcataagctctatcagttcaagcgaaattttgagaatcttaacacaaacagtaaatctattaaatccatttgagtgtttccttagcaacggttttcgggtgttatttctgttaatgcgtatagtgtattgtaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatagtgtattgtaaggttgtcatatttactggaattatggaaaatcgacaccaaacgccactgcttgttttatctatccttacctatttcctaaaaaatctaaaatttaacttcttttaaatcaataagttaaatataaacccaaaatcttacatttttgtaagtacttccataaaataagttaaacatctatactgccctcaatttacttacttttaggaagtaaaaatgctgtttatcttattatttatttttagcttaatttttattttcgctattcgcaaaaaaaaacacgcttactgcatttcggtacattccgttttgccaaaacgattacccataatcaacaccgtttttatcttgaagaagtggcgtttgacaatcggcagcaagccattcacggttattttcagcttgctccagccttgcaaaattatggcaaggtgcaggaaacggagtacgatttttttgatttttattcggtggtgctgcggtttgacgactgcacgatgaaactggtgcggtggcaggtttaatgtacaggggcaaacagccaactgctcggctgctttcaccctttgcacgcctgtatcgacaacgccattcactcgcaagcaggcgtgcaacttcgccttgcttgtgctgaattgatggaaaaacaagggcatttggaacccacagggcaagcaaaaatcaccccagtatttaacttgccgtctgcccacgttttgcacactgtggggccgattatcagtggtgcgttatcggcaaaagattgcgaactgctcgccagttgctaccgctcttgcctagaactcgccaagcaacacggtattgagagtgtcgccttttgttgcatcagcacgggcgaatttcgtttccctaatcaagaggcagcagaaatcgccgtgcaaactgtcaaagactttttagccgataactcacaaatgaaggtggtgtttaatgtgtttaaagatgtggatttagagatttatcgggggctgttgggggagttgataaaaagtgcggtcaaatttccacaaatttttgcaattgcaaaatccataagaaatcccaccgcttgcaattagctatttcttttggcttttcaaaatcccattcaaattctcttccaaccagtccaccaaatccacaaggcgactgccagcctgtaagccaaaatccgtcagcgaatattcaacgtgtggcggaacggtgttgtaggatttacgattgagcataccatcttgttccaactgttgtagcgtttgggtcagcatacgttcgctcacgccgtcaatctcacggcggatttcgctaaaccgttttgtgcctttcatcaacacaatcatcaccaacacgccccaacggttagtcagatgttgcaaaatctcacgagaagggcattgagcggataatacataaccccgttcgattgaatttgaaaatttttccatttttatttccttatatttcaatagattacaaaatatcttcatttcttacatttttgtaagtacttctcaaaagtaagttttaatctataatacgccacatcagccagtttggcaaatcgcattaacttaacaaaggaaaaagcaatgaaaaaatcaaccgcacttttcgtttcagcattagcaatggcaaccgcagcttatgcccaaaatccacaatcaactgtatcaacaaaaggaaacacgacaatgacagcccaagttcaaacaaacaatatccgcaatgcacaagcgttaatcaatattttgtatcgggcgacagtgccaaagcttgcagcttgcttgcaccaaactacattcaacacaatagccaaatcgcagacggcgtatcaggcttaaccgctgcacttgaggcaataggcaaacagggtatcacaatgcaatcgcttttaggtgaagtgcgtcggttaattcccaagccgctttggtaatgtagccttcgatagcgtgggtcaatgcgtccatacctgttgctgccgttaatcctttcggcattgatgacatcatatccggatcgacaacggcaacggctggcacatcgtgaacatctacgcagacgaatttacgttttttctcttcgtcggtaattacatagttgattgtcacttctgctgctgtacctgcggtggttggtacggcaatgattggcacgcattttggtgggttggtgcaacgccttcaagggaaaggacatcgctaaattctgggttgttgatgatgataccgataccttttgcactgtcgataggtgaaccaccaccgattgcaatcatatagtcagcaccagaggctttgaatttttctaccccttttttgatgacacaaacagccaggtttgctttcacttcatcaaaaatttcataaggtaagcctgcttcgtcaagtaagttagtcacttttgctacgacttgataacgcacaagatctttgtcggtgacgattaaagctttggtgaaactacggctttttacttcgtgaacaatgtgttgaattgcacctttgccgtgatagctggtttcgttaaggataagacgatttgccataatgtttttcctcttaaaatttacaagttcaaatacgcacaagggagagggcgtaagcgtaaaattcagaagaaaacagaccgcttgatccctctcgaaatccccctcattcccccttttccaaagggggaagtttgatattccccctctttgaaaaagagggggtagggggagatttttattagtaaagtaccgctttcgcttctggagagtcgatgttttcttttgttacataaactacaccagtatcaataactttctcgactttttcacctttaataattttgccgatagtatcaacacctttgtagcccatttggtatgaagattgcaccacgataccgtctaaagttccgtcacggacgaagttttgaaggtctgagttaccatcaaaaccaacggcaacgattttacctgcgaagcctttttgtttcacagcacgagccataccgactgcggtcggttcgtttgcgccgaagatcgccgcaatatcagggttagaacctaacacgtcttcagtttggttcaatgcggtaaccatttctgaatttgagtagtatggaccaacaattttgtaatctgctttagatttcacttcatcaatgaagccgcctgtacgttcaatcgcagaagctgcaccttgagtgaatgacatcactgccactttaccgcctttcactttagctaataatttttcagcggctaatttaccagctgcacggttatcggttgcaaggaatgattgatagtatttaccatcgctgtttaagcctgagtcgattaataccactggaataccgctttcataggcttttctcacagctggcacaagggctactgggtcagaagccgcaagcacaatacctgcaacaccacggttcacagcgttgtccaccatattgacttgtgcgtcaatcgcagtttctgattcagggccttggaaggtcactttatattttccgcctaaatctgcacctgcagtttctgcacctttacgtacgttttgccagaaagttgagttagcggattttacgatgactgcaatttcgtctgattttgcccacgctaagcctgcaaaaagggtagataaacctaatacagttgtggttacgattgctaattttttcatagttaaatctcctctagagtttatttcttaccaagttttttagattgacggagctggtctaaagacacggctacgataatcaccaaaccgataacaatcatttgcacaaacgatgatacgccattcatattcaaaccattacggagtacaccgataatgaatgacccgattaatgtgccagggatggtaccgacaccgcccatcaacgatgttcccccgactactgcacttgcgattgcatctagctcgtaagccacaccgccgtttggctgtgctgttaccaagcgagaagcaaggattacgcctgttaagccagagagtaagccgctggcaacataggcataaattttgacaacattggttttgataccagataagcgagccgcttcttcatttgaaccgatagcatagatgtagcgacccacttttaatttagttaaggcaaaggtaaagagtactgtgatgaagatcataataatcactggatacggaatacctgcaaacaccacttttggtaaaccatttggaccttcttccacaattttgaataacgcaccgttacctaaggctgcgaaactttccggcatacctgaaactggagcagcgttagtgacatagagtgctaaaccacgagcaaccatcatcataccgagtgtggcgataaatggcggtaatttcatttgggtgactaaaataccattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaatcattgcagcagcaacccctgaaagggcaactacagaacctgtacttaagtcgataccgcccgttaagataacgcaagttgcaccgataccgattaatgcaatggtcgatgtttgcagaccaacagtcataatgttgttagaggtaaagaaatagtcgttggttacactaaagaaaatgactaagaggattaaccctgccaatgccgccattttgcgaagcagatctttatatttatcactcattttaaagctccttagtttttatattcgtttttgaacatatttctcacgccagtggcatattgcataatctcttcttggttggttttcttggtttccaacatacctgtcattctgccctcacgcattacgataacacggtcggtaatccctaaaatctcaggtaattcagaagaaatcacaatcacaccgacaccattggcggcaagttcatcaattaactgataaatcgcatatttcgccccaacatcaatgcctcgagtaggttcatcgaaaatcatcacattcgcatcacggaacaaccatttgccgataaccactttttgttgattaccaccacttaagttgtttactaactgctctggtgttggtgttttaatttccattttcttaataaaggtatcgctcgctttcagctcctcattgtgtgaaataatgcccagctgatcgcatactttatccattgaagccattgtgatgttctcacgaatagacattcgcaccgctaccccatttagcttgcggtcttcagataggtaggcgatacctgctttaatcgagtcgcttggatcacgaataacaactttcttattccgaacataaatttcgcccccatcaagcggatccgccccaaaaatcgcacgggcaagttctgttcgttttgccccaactaagcctgtaattcccaacacttcgccttttaacaagtcaaagtttaacggctcaaacacgcctttacgttctgcattcatcactgaaagtaataactcatcactgattttggcggtttttggtgggaaatggttatcgagggtacgtcctaccattttggtaatgatttcgtccatcgtgatgtctgaaaaacggtggctagagacataagtgccatcacggaaaatggtaatgcggtcgcagatctgttttagttcatccatacggtgagaaatatagacgatacacacgcctttctctttcaagcggcggacaagctcaaataatttctcaatctctttttccgtgagagcagaagttggttcgtccataatcaacacttccacatcaaaagagagggctttggcgatttccaccatttgctgacgagcaacggaaaggtctttcaccagatcggtaggcttcacatcaatatcaaacatattgagcaagtcggcggcatctttattcattttggctttatcaacaatgccaaatttatttggttcgcgggcaaagaagatattttctgccacggtaagatgaggaatgaggtttaactcttggaaaatcatactgataccgtctttctgagcttccaacacagaagaataattgacggctttgcctttatagatgatctccccttcatctgcttgataaaccccgatcaaacatttcattaaggtggattttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgattattttatcggctatctctattgagaaaacaaccgtatattcaaacaaaattgaccgaataaaaagaaattttacgaagtaatttagtttttgtgattcagctcacaaaaaaagcaaaggttttcgttttttgactgcccgattttaagaaaagaagaataaatcgggcaaaagatagaacataggatagggagtagaaaaaaatgaacacaattacggcagtgttgcaatcacggcatagccatccatttcaccaataaaatctacttggctattagcgctgataaaaattgcttcgccttgttgtaaataaatcgagtcatatcctaaatcgacatacaaacttccagacattactaataaaatacttgcacttgttgcagtaaattgtccttcatcaaatggtttaaagctgagtcgctgtaaggcaaagtcctctgcttctggtgttggatataagtgcagtaactcttcactattattttcctcatattgaggaataatcttaggtgtaattgctcgataatcaatcgtatgtagaagtgctgggatatctacatatttaggggttagccctcccctaatgacattgtctgaggctgccattagttcaatattttgtcctcgcaaataggcgtgaggtaagcctgcgccttgataaattccctctccctttttgagatttacaatattaaatagatagaaacagagaagccctgcatctagtttatccagacttattttcattgcatcaatagtatatagtacccaatagtcaggatcgtctagtttaagtctatcttgttgataatcctcttgtttattttcaatgatgggcaataaccattctgcaagctgagtttgttctgcttgcataatggaggcataaaccgttggtaaactttgtttttcaatcgctttcgccagaccttgtaaagattgatgcttcattaggctttctttaatcgcatcttcagatttaaacccgtgtaatagccaaaagtctgataatgcaatcatcatttctggtttatgattacgatctttataggtgcggtttgaggcatttagtggaataccttcataattttcacgttcaaaaccgtgttctgcctcttttttagttgggtgaagttgaatcgaaagcggtaacttcacatccaaaattttcagtaagaaaggtaattcatctccaaattgttcacgcgatttttctcctagtatttgaggcgccttatctaaaacgcgatctaaaggcaaccatgctccttcaaattcaatcattgaaggagcagaacggtgtgctccaagccaatattctgcatagggtttctcttcgtgagtgtcaagttttaaccagttgggtatgaaaatatctccaccccaatcataatgttgatgtttacccactaatttgaaaatcattttttgtatcctccaaagaaattgacaactcgttcaatatcttctttttgtttaatccgaataaacaatcgcctattattttttagatcaatgactaaaatattctgatctgccaaattaatttgtgcaatatggctatataaaaaatagaaattgccaaagaaaaagccttgttcttttaatagtaaacgagggtaacgaatgaacgccgaatagactgctaagacaatacaaccgcataataagaatacagtgagaggttcaatacctgtttgcactccttgtacgataattaacacaattagggcaattaaaatcccggtgtctaaacttgcttgtcgaattaacggcacacttagtcgggtttcgccgtttcgtctgtccataatgagctgatcatagagaatatagagcaagctcaaaccaatagctaaaatcagaagtatatttgtcatttgtagaatgttcttaaaaaaagaccgcttgtattttagcacaagcggtctaatttatcggattttttgcaaattatgcaagaatacctgtccacgcaccgaagataccgataacgaagaagccaacgataatccaaagtgcattcacacggttacgtaataaccacatacacgcaaatgttaaaagtaacggtaataagcccggcattaagctatctaagatagattgaacggtggtaatttccgttgtgccgtcttgtttttgaatggtagaaaccacaagcggtacattaatgcttgtccatttctgaactaacgcacccataataaacaagccgagaattgatgcaccttcggttaatttttgtaataaaccgccgctcatatcttgtacaacatttaagccttttttgtaaccataaacgacgccgtagtaacgggttgctaaacgcacaaggttaaataatacgaagaatagtagtggacctaataagctacctgttaaggcaacgcctgcacctaatgctgcgaatactggacgagctgtcccccaataaatcgggtcgcccacaccagcaagaggccccatcaaaccaactttgatcccgttgattgccgcatcatcgataggtttgccgtttgcacgctcttcttccattgcgatagttacccctaatacaggagccgctacgaatggttgagtattgaagaactctaggtgacgtttgatagcatctttacgttcttgtgagtttggatctggatataaacgtttgataacaggcaccattgagtaggcgaaacctaacgcctgcatacgctcgaagttccaagaaccttggaagagattagaacggcgtaccaccgcattcaaatcgccctgtgttacttttttgatttcagttgtcatagtcttacttccttagtctaatctgttgtcaaggtcgttgtttgttgcttgcacttgcaccacttgtttactttggttgtatttcgggtgaagttggatataaataatcgcagtgatagtacctaaaacccctaatgctacaaggttgaaatcggtaaatgctgcaattacgaaacccgcgtagaagaatggcattaagtgacctgcacgcatcatattgataaccatcgcataacctacaaccgcgataaagccaccggcaattttaagacctgttgttacaactggcggaatggctgctaacatagattgaacactatctgtacctgctgtcatcgcaacgattaacgctgggattgcaatacgcattgcttgaagtaataacgctgaacggtggatccaatccagcttatttaagtctcctgtttcaatcgctttatctgctgcgtgttggaaaccgactgtaatcgcacgtacaacataagttaaaacttggcctgccgcagcaagtggaatggcgagtgcaatcgctgtcgggatatcttgtccgctcacgataactaagatggttgaaaccactgatgctaatgccgcatctggtgctaatgccgcaccgatattcatccaacctaacgctaataattctaatgaaccaccaacaatgatccccgttttcatatcacctaatacgataccgattaaggtacaagcgattaacggacggtgagtttgccactcatcaaggattgatcccatacctgaaatacaggcgacaaggaatactaagataatttgtaatgtagaaatttccataataatttccttagattaagttatttttcttgagtaaatccatcatatattgacggctatcgttcgatactttacgcacatcaagttcaatacccttcgcatctaatactttaaatgcttcgatatctttatcatcaacagcaacggcactggtaatcattttcttaccatctttatatgccataccaccgatattgatcgatttgaactcaacacctgcttccattaaacgcaccacgtctgtcggattagtgaaaagtaacatcatacgttcattcgcatattcagggttgttgtaaacacggatcatcttatccacaggtacaacgtgagccgttactcctggtggtgcaacacttttcagcatcgttgaacgcacactatcttttgccacatcatcgttcactaccacaatacggctaacacggctctctttcgtccagcgagtcgccacttgaccgtgaattaaacggtcgtcaatacgcgctagaccaatcactaaattcccttcttgattgacttgagctacttgtggttgtactggagcttgagcagcagtagcaggttgtaccgcaggtgcttcttctttctcctgatagcgtaatgcacgcacgcctaaacgtcctgtttcaagagcgacttccactaattctgataaagacggaccatcatcacgtgccataaaggtttcaacgagcatcggcacgtttacacctgtgacgatatccatattctctttgccttcagacacacggtttgccgcattaaacggactaccgccccaagtatcaacaaggaatagcacctgatcgcagtgagcgagctcattcgctaatttctcttgatatttacccataatagtttcggcattttcaccaggtacaaagtcgatagtggctacatcactttgttccccgattaacatctctgtggttttgagaagttgttctgcggcgacaccgtgggttgctatgataatagcaatactcattggttgctccttatgtgaggatttattcggattattaaaacttattctcaatagagtaaatttcggagtggaattttaaaggatgccgatttttcagcaatctgatttatataaaaatgtgatctacttctcatttttgagttaggtaagagggttatttgctgattttatgagcttatttttttattataaaaaataattatctaatttgactatggagatataaaaatgtctgtatcttatagttgtcacttcagatacagacacagattgtagttagggggatacttcaccatctatcaaacaaattaacagatatattctcagtctagctttgactcaatcaacttaactaaaaagctaatatgatcgctatttgcattcaatgctgaaatatatctgtagttatttcctcctgcatttttaaaattttcctgattttcttcagcaatttcttcaattgtttcaaggcaatctgcggcaaaaccaggacaaataaccgctatgttttttatatttttagtaggaagattcgataaaagttcatcggtataaggttgaagccactcttcactaccaaaacgagattggaaagataaaagccattgattttctgtcaaattgagctccttggctactaaacgggcagtttctcggcattgttctgaataaaagtcaccttctgcttcataacgagcaggtataccgtggaaagaaaaaagtaatagctcattctctgtaagcgttacagtatttgctaatgctttaatatacaaagggtgattatggtaattgtgaataaattcaaaaggcaaaactttcttgtgtttatataatgcttgtgcaaaagcatccagcactgaggctgttgttgttgagctatattgagggtagagtggaagtataataattttttctacatcctgtgctataaggctatcaacagcactctggatactaggattaccgtaactcattccaagttcaatgacaatattgttgttctgtgagcaaaaataagtctgaatagcggcttgctgttgacgagatatagataataaaggagagccatcttctgtccagatagttttataagcctgtgcaactttaggtactcttttaggtaacacaagacagttcaaaataaatttccaacgccacttcggtaaatcaattactcttggatcgctcaggaattgtcttaagtaacgtttcactgccggagtagttggttcatcaggagtgcctaagtttgctaatagcacaccaattttttttgatttattcatagaaatccttcatgggtaattagttatagacgtattatagagtattagcaacatcaatactatttatcaaactaacaggcaaaaatataaatagatattatatttgtcagatttatctctatagtgaaatacagaagacatattagtgcttgctttatgctactgtttaagaaaaatacaaccaataaagtgattattagataaactgtccttgtattaagttttaatgctcatatacattaaactgaaccatgattccattctgtcagagattgttgttagatctaacgcttcagattgttcagtgatacgagtcagatagggatttttatttatatcaaaaatcttttttaagatttttgatggatccaattctttattcttgttattaaagtattctgtaatactatcactaagtgcccattttaattctgtttggcttgccaaataatcttgtaaataaagatttaatatctccgttgcttctgtttgcgaaatatcattaaaggttaggtaatttgctttttcaccttgtcgataataaaaacgtagcgaaagaatagggtgattatttgcttttaataacaaataataaatccacgcttgaataatatctttatctcgcaatccccctactcgccataataccacttcattattaaagcaatttggaacattacctacaagttgatattttctctctgcaaaaataacagagtgttctatttcaataatgtttttctcttgcgacaaataagaagataacgtatttcttaaaagctgaatatcttcagtgagttttgttttattaatctctgcaaaataacgagcgggtagatttccttttaatttttcattctcaaaaaagatttcaatatcttgttcttcgacttgaattaaatcatcaagtaaattatatttttctaagccagacaattggaaaatttcactttcttcaattttatcttcattctgctcaaaacgaacccctaattgttgttggaagaaatattttattggttcttgaatataatgaataaactggttaagtggaatatctgacattatatcttcctgcgttttagttaatttctgcaagaaatctttgcgtggtaaaatattatttttaacttccaaccactctttatcataagccactttgccatctttgaaattatttgggctaaatacggtcattgggtggacagacaataatttagtatagtcagctttaggcaggttttctttcaaataatcaaataattgtgtcaccaacactgatggtaatttttcttggctacttgtgagcgattgcccaatataactgatatagagcatttgttgagccgatagcaaggtttcaaggaaaagataacgatcatcatctcgtcttgatcggtcgcctttttgtggggcgtactgcattaaatcaaaactgttgatcgtctgttggcgtggaaactcgccttcattcatacccaacaaacagactactttgaaaggaattgctcgcatcggtaataacgtacagaaattcaccttacccacaaggaaatttaagtggctacgctgttcgctcagttgttgagtaaatagctcaagcatcacatcaatacctatcgcttcttcaaaatggctttgctgaatttgctcaatcacatcacggatagcctgctgtaacgtcaaaatcgcatcaatactttgatcgttttcttgataggtctgtgccacaagggtaaacagctgttcttgccaagcagataggctctgtggctggcaaataaaggcgtgccaagcggtgagattgtcgataaattttgctaaattccctgttaattcagagattaatccataactttcatcaaaagctaaaatgttctgccagccattattttccgcttttaaacttgtgcctaacaataatcggtttagcccattttcccacgaattataattttgccattctgggttctctatttttaagccagatctaatgccaaccgatttaatccattctcttaatgtattaattttctgctcattaaattgatatttttctcgaatagctgaaatatcaaatagatctaatatctcttctgctgagaatttattttctttaatcgataacaattgtaaaaagctagcaataattggattaatataactaattttttgatctgataaggtaaagggaatatatcttctctctttttcataacgagaaaataccgcattaatataaggtgcataactatcaatatccgcagacatcacaataatatctttcggggataagtcaggataggtttcaaataaatataataattgattatataatacttctacttcacgcattttgctgtggcaagtgtgaagctgaatagagcgatcttcattagctaaagagaatgtagtttggtgttctgaatataaaatcgctttttttacttgggttaataatgtcggatttttatcttcaaaatgattataaagtgatatatcttgaatacctgtttcagttaataaatttaaaaattcttttccttgttttccccaaactgttaataatgggtttccttgtttttcaaataactctgctaattctgcttcagataaattatcttttaacgctaatttttctaataccttatcttcacgatcatttgcccagtattccatacttggattagtgaaaaagaggtgaacattgcaatgctcactcaattttttcaatacggcgagctgagaatggggaagggaagaaatgccaaacataaaaatccgtttcggtaagcgagctttttcagtggcagttaaattatcaagtttatcgaaataacgctgttgcaaataagcacggtgtgaagtattaaaaatcgcttcatcgctatcctgttttatatcggcaaccaacgcattccaaaggatactttgccacgccacattcgttgcaatctcttttgcatttttttgcttaaaagaaaccgctcgcataatctcatcaaccaccgcttgcgattgccccttttcccatagcaccaaccattgcggacggtacacgagatattggtcaaacagatcggcgattttctctgctaattgatactgttttagctgatcgccttggtttaaataggacgcaagtgcttcaaaggcaggttgttcaaggaactgcggaataattcgcattaaacgccacaacattgactggcgctcaaagctattctctttcggcaaatcaggaaaaagcacgcgatattgttgccataaaaaactggttgggtaaggaaattgcacattaccagccaccccgatttcttgagcaatctgcatttgcaaccattgtgccatacctaaactttgtaccagaacaatctcttgactaaatggatcggggttgggatctttcgctaagatcgcagtcaatagatttttctgttcggttatttggtttgaataatatactctaaacatagcaactcccctttgtaagcaagctattttagcgagtttggggggaatgatctatttggcaacctaatttataattagaattatagtgatgttattatctatcatataattcccaacgcatatttcaacgcccgttttttcaacggcgttgcacgttccgccacaattaacgcaacattacgcgcgactttcacaggtaataaatctgtcttaaaggttttataaaacacatccattcccgtttgcattaacagattatcaggcttacgttttcgttcgtaaccatttaacaccgcttcatctgcaaaattctgccctttttcgaccgcttgttctatcacttcaagtaaggcttttacatctttaaaaccaagattcaccccctgccctgccagtggattaatcgtatgagcagaatccccgactaagacaatcccatttcgcacatagctttgggcgtgctgacgtgtgagtgggaaactaccgtgagcggtcacttcaaccttgcctaaacggcttggaaaatagctctgaatctctgcactcaatttctctttgctcatctgttgcagttgagcaatacgttgtggcgaatcataccaaaccacacaaccgttatactccagtaacggtagaaaggctcttggaccgctttcaaagaactgttgccaagtgacactctgttgcagtaattctgttttgactacggcaagcagacagtgttggcgatattgccagctcgtcaaaccaatacccgaccagcgacgcacaagggaatttgcgccatcgcaagcgatcaataacgcagaaaacacctgctgatcaagctcaaccgtccaaacaccgttctcatcacgacttgcagaaatttgctcaaaaccaaccgcttgctgacagtttggatactgtgccaatgcttgccaaagcccaagctgaataaggttgttttccaccatataacccaacttatctaagccaagatcatttgcatgaaaagcggtattaaagccatcaatttcccacgtttctaagccgtcataaggacaaactcgcatcgcttcaatcgcctgccacgcccctaatttctccaacaacgcaacggaagccacactaattgccgaaattcgcacatcataaggtgcatttggatcaaatgtcggcaacggatttttctcaatcagaacaacctttagccctagctttgccagccctaatgctgtcgccgccccgaccattccaccacccattacaatcacatcttgttgagtcatcgtcattttcctctcaaatttgttaggcggaagtttactacaagcggtgagatctgcattgatttttgcaaaatttttgtgaccctcgtcgaaaaatgattttctctcacttgtctttttgtcataaaaattaacaatctcgtgattacttcactatatgaagtttgcttgttattttgtattgaaaacattacaatcatagaaaatcaattatgtacattattgaacaaactgaaacctttaaattatggctaaatgaactcaaagatcctattgcaaaaattgcgattatccgtcgcttagaacgagcaaaaaacggacattttggagatcataagtcgctaggtgacggcatttatgaaatgcgattgatgataaacaaaggctaccgtatctactatgcaagaaaaggggaaatcatctatctcattatcaacggcggatacaaagacatccaagagcaagacatcgccgtagcaaaaagattctggcaacaataccaacttgaacaggaataaaatcagatgaaagataaatcgtttaacggacaaatatcaacgttcgatgctgctgagtatctcaataacgatgaacttatcgcactttatctatcggaagtactaaaagacggtgatgaagctgaattcattcaagcgttaaatactattgcccgtgcaaaaggaatgaatgaattagcccaaaaagccaatatcggtagagaaagtttatatcaaacactttcaagcaaaaagccacgttttgaaaccattgtgaaaattctttcagcgttaaatattgagctagtgcctaaggttaaaactacccaatagcttttatcttttcactatttttgtgacactcgtcgaaaaaccacaatattaaaattgcgttccctgtaaccatctcacaataatatgattttatcacatacattgacttcattatttgaagtcataaaatagggaaatcaaatgcgaaagaaacatcagcaaacactttatgctattttcgcaacaccaacatcatctaatatcaaatggaaagagatagaatctctgattgaagggttaggtggtgagattattcaaggtgaaggctctagagtacgatttaaactaaacaatagcattgctcgttttcatcgtccacacccatcaccagatacagataagggtgctatcgcaaacttgcgtgaatggcttactaaaataggaattactccaaatggcaacaaaacaacaacctaatattatctatattgatcattatcctgctattgtcagctatatacctgaattgaagatgtttcgtgggaaatttctcaatacgacgggatattgtgatttcattgccgatagcgtagttggtttatatcaagaaggaaaaatctctctagatgaatatctagtagactgccgtgaaaacggtattgttgcatttgagcaagaaaagcaaaaaacctttacattacgctatgatgaaactctatcagaacttgttactcaacaggctaaagcacgtggaatttcaattaatcacttgatcattgaagctattgagcaacatttagcacaacgactttaactatttttgtgacactcgtcgaaaaaccaacattttttgctattcaaaaacaaacatactttttacgctaatacaaaaaaggaaaaaagtatgtctttagcgattatttacagccgagcatctatcggtgttgaagccccattagtaactattgaagtgcacatcagtggcggaagccctggacttaccctagttggattgcccgaaaaaagcgtcaaagaagcacaggatagggtgcgaagtgccttgatgaatgccaattttgattacccagcccgacgcattaccatcaaccttgccccagccgatctccccaaagaaggcggacgttttgatttacccattgccatcgggattttggcagcatcggggcagattgatagcgataaactcaaacggattgaactgcttggcgagctgtctttgacggggcatttgcgtggggttcacggtgctattcctgcggtgttggcagcaagtaaagcgaaacgggaaattattgtgccacaacaaaacgccaatgaagtttccttggtttccaatacccaaacccattgtgcttcaaccttgttgcaggttgtcaattttctcaacaatcgagatcaactgccgattgctcagcagctttcgcaaaatattgccgaaaacagaccgcttgtcagccgtgatttaaccgatattatcgggcaacaacacgccaaacgggcattgattattgccgccagcggtcagcataatctgttgtttttaggtccacctggtacaggcaaaacaatgcttgctagtcgccttgccgatctgctgcctgaaatggaagatgatgaagcaattgaaacagcatctgtcaccagtcttgtacaaaatgaactcaactttcagaactggaaaaaacgcccgtttcgttccccacatcacagtgcatcaatggttgcgttggttgggggcggttcgatcccgaaaccaggggaaatttcactggcacacaacggtgtgctgtttttagacgaattgcctgaatttgaacggaaagtgttagatgcattacgccagccgttggagtcgggagaaatcattatttccagagccaatgccaaggtgcagtttcctgcttgttttcaactgattgccgcaatgaacccaagcccgacagggcattatcaaggaacgcacaatcgaacgtcaccacaacagttaatgcgttatctcaaccgtttatcagggccttttctcgaccgcttcgatctctcgattgaagtgccgttactgccacaaggtgcattgcaaaataacaccgatcaacgtggcgaaactaccgaacaggctcgcaagcgggtacttgaagcaagacatttgcaatttaaccgtcgggggaaaatcaatgctcaactgacgaccaaagagattgaacaagattgcaaactgactgatcgagatgcgttatttttagaaaatgccttaacgaaattaggtttgtcagtgcgagcttatcaccgtattctcaaagtttctcgcaccattgctgacttggctggagaagcccaaatccaacagccccatctggctgaagctttgggctatcgggcaatggatcgtttgttacaaaggttacaaggggaaagttagttctcaaaaacctctaacaccaacttactcaaacagtccaacaacatcaactcttgattgaccgcattgacttcgcgtaaatcccgttgggtttgttgaataatttgatgccctttcagtaaaccttgagcggtcagctgttggctaaaaggcagaataccgttttgcagatcaggattgagccaacctgttgcgatttgcattttggctttcagggcatcgctgaaaaacgaacccagccattcaagctgttgttgcacttgttcaggttctttgtcaaaagcagaaaagagcaagaaaacatctcggcttttgtaaaaacgccaaaaggtctgcaaaaaggttttacggcttggcaagcggtcagtttcaaggaacgttttgcaaagcaatgggcggttgtggcatagacgaagtgcggtttcaatctcacttggctgtgctgtcgggcatttcgtctgtaaccattcaaatgtttgtgacggctcaggcgtatgaaccaaccacgtctggcaacggctttgaatagtggcaagcattgtgacttgcaaaggggcttccaataagaaatagacattttggttcggctcttcaagggttttcagtaacgcattcgccgctgcttccgttaaacgttccgctccagccagataaactacggcatttccgccttgttgagcaaactgttgtaatttggcagtgatttctcgcacttgatcgatcccaatatctttatcatcaatcggggctaacaggtgaaaatcagggtgattgccgctctgccataacaaacagcttttgcattgtccgcaaggttggctctgttgtggcgtatggcaaagcaaccaatgagcgaaatgacgaataagttgctctgtacctagcccactgtctgttttaaacaataaggcgtgatgcccccgaccttgtaggaaggtcgaagtgatttggtggtggggttgttgatgccaaggataaaggttcatattcattcaacaaattaccagctaatattaggctttcgttgttgagcaacacaatctttgagataaagattgattaatgtctgataaggcaaattaacctcatcggataattttttaaaataatctatcgtttcatcttcgatacgaattgtgacaactttttttgatttcaacgttgtcgcatatgggtttttgataccgttagaaaaatcatactcttctctcattgttgcctcccattttaaaaaacatttgtatatttcagactgctaataaaactaaatatgctcttatttttcattcgtttcattactccctcactttgcctttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaaaaccgaagagaagaagataaaaacttaccaaatcattttgtcaataatctgaaaagatgtatatgcccctttcgtaaatatattatatttacacattcaaaacaatcttcagattatttctctgatgttaaaaatatttccaccgcttgttgaatatccgccgacacctgttctatcgcaggttcagcgttaatgagcaccgctttcggattatctttgactaaggatacataacgctcacgggtacggtgaaaaaagtcgatatcgagttgctcaatacgatctaacgctccacgccctcttgctcgctctaaacctatcgatggctcaatatcaaggtagatcgtaaaatcaggctcaaaatcacctaaaatcaccgaacctacctcatccaccaattccgctaatccccgtccaccgccttgataggcttggcttgacatattgtggcgatcgccaacaacccatttgcctgaagctaaagctggttcaatcaccgtttcgactaactgtgtacgagccgcataaatcatcaatacttccgctttgtcggttgtatgctcgccgtcttcgccttctttccatagattgcgaagtgcttcggcaatcggagttccgcctggttcacgagtggtaataaattcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagtctcgcaccgctttattatgctcatctaaagtacggctgaatttatgcccaccagaaccgtccgccacaaaatagaaataaggcgtactgtcaggctgtgccgtcgccttaattgacgcttcgctcggcattgcaatcggtgtcggcggtaaaccatcaatcacataagtattataaggagtaggttcaagcagatctttcttacggatattgccatcatatttatcgcccataccgtaaatgaccgttggatcggcctgcaatttccagccatttttcaagcggttgataaataccgatgccacttgcggacgctcattcgccacgcccgtttctttttcgacaatcgaagccaaaattagcatttcataaggcgttttaagcggtaggttttctgccctattttgccaagcctgttccaacgccttttgctgtttttgataggcacgtttaagcacatcaatatctttggaataaggcacatagctataagtatcaggggcaagccaaccttccaatttatcctgagtgattcccaatagtttagcaatgtcagcctctgttttatccgtcaaagtttgttctaaatagcgagcctttgccaactgctcacgccacgttttaaaggtttttccttcaataaattgcacatttaactgcacttctttaccgctattgaaatgttgcaacagctctttcaccgtagcgatattatctaacgcataaaccccagccttaaatttactgagtttagggttaaggcggatcaaatagggtaatagctccacatcatcacgatgaataatgccttgctctgctaatagctgagcgagtttttggcttgatgtacctttttccaacacaaacagttgctcaggtttaacggttaatttatgttcagctaacagattgagtttctggtaaacataaatgccaccgccaagggcaataacagataaaagcccaagagaaataagaattttttttaacattgctatgaagttttaatcaaaagaaaaacagagtaaaccttactataaggcaaccaaaaaagccacgacaagcggaaagattttttcgatttgatgcaaaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgttgcgtaacgagggcgtatcatacggattttacgttggagatcaaccctttttttatatttttaacttatttgcatagtttacaagcaaataatatcaacaagcggtgagattctgtaaaaattttaccaaatctaaccgcttgtctttaagcgaaaaaaattacgctttcgctttttctgctgcttttacgatcaccgcaaatgcaggcgctttaagtgacgcaccgcccactaacgcaccatcaatgtctggctgagtaaataattctgctgcattcgcatcattgactgaaccgccgtattgaatgatcacttgatctgccacggcttgtgactgttttgcaatgtgaccacgaatgaaagcgtgaactgcttgcgcctgtgctggggttgcagatttacctgtaccgattgcccaaactggttcgtacgcaattactgcaccattgaatgcttctgcacctaaagtatttaatactgcatctaattgacgggcacatactgcttcggtttgaccagcttcattttctgcttcagtttcaccaatacataacactggcactaaacctgcttcttttaatgctgcaaattttttcgcaataaattcatcgctctctttgtggtaagtacgacgctcagagtgaccgataatgatatatttcgcaccgaaatcttttagcattgctgttgaaatatcccctgtaaatgcaccttgtacattcacatcaacgttttgagcgcctaatgcaatgagtttattcgtggtgcattcacagccacagctcgctaatgccgcttctgcttctgctaaatacattactggcggtgcgattgcgacatcacaacctgtaacaccatcaagttctctttttaagctttccactaattctttagtgaatgctttgctaccgtttaatttccagttacccattactaacggacgacgtgccattttgtttctcctattgagtgaaatgtaaaataaaaacgtgcaaactataccaaatttcacagaaaatttattgtttttccgcaagatttcagctcaatatttaaaaataactgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttaatatgagcaaaaaattgtaatggaacatcaagatctactggcattaacggcaaaagaacgaatgaactcatctcgccgtgcaatgttttgtaaaccacagcactttgaatgggcatttgaagatgatggattgcggttgaaattctttttagacgctggcagttatgccatagcgttggtgagagaattagtacagctcgaagaataactaaactttccccctttgaaaaaggggggaattaaaactataaggaaataaatcacaatgaatatactattaagcaatgacgatggctttcacgcccacggtattcaatttttagcgaaagcattaagagaagcaggacataaagtaaccattgttgcccctgatcgcaatcgcagtgcggcatcaagctgtttaacactggttgatccgcttcgtgtgcataaatttgagaatggtgattatacggtgattgcaggtacgcctgccgattgtgttcatcttgcattaaatggtttgcttgatgagccgtttgacttggtggtatcagggattaatcacggggcaaatttaggtgatgatgtggtctattcgggaaccgttgcggcggctcttgaaggtcgtcacttaccgttgccatcagtggcggtgtctttagtgggttctcacggttcaacctatttaacaggcaaatgccatttcgatacggctgcacaagtggtggttgaactattgccgaaaatcacggcaaatcttattcctgcaaatcaagtgttaaatgtgaatgtgccaaatgttccttatcacgagttgcaaggtattcaaattactcggttaggtgatcgttctcctgcggctgagattattaagcaacaagatccgcgtggggcaaatgtgtattggattggggcaagcggtaagccgactgatgaaagcgaaggcactgatttttatgcgatcaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttatgcgatcaaccataactttgtgtctatcacccctattcaaccagatatgactgcatatttgtcaatttcacgtttaaatgagactttttaaatgaaactttttggaacaatttatgataaaacgatggaatggtcaaaacatcgctttgctgcaggctggttaagttttgtcagttttattgaagcgactttcttccctattccgcctgatgtgatgctaattcctatgtcgatgagtaaaccacagatggcaacacgttatgcgatttatactacgcttgcatcagttttaggtggtatcattggttactttatcggcttatatgcatttgattgggtaaaagggattattacagactggggaatgcaagcaagttttgatcaagccatggattggtttgaaacttggggagtagcaatcgtctttttagcaggcttctcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttttagcaggcttctcgccaattccgtttaaagtatttactatttgtgcaggtgtattgcagatgtcttttttaccctttattttgaccgctgcaatttctcgttttgctcgcttcattcttgtggcaaaattatcagcttggggcggtgagaaatacgccgataagatccgtcgctcaatagaattaattggttggggaacagtgtctattgccgttgctgcctatgttatttataccttattaaaataagaggctattatgaaaaaatcgtttcttttacttccgcttgcagcagtagtgttagctgcgtgttcatcagatacatcgtcagaaacctcgcctaatgttgaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaacctcgcctaatgttgaagtaacagaggctggatctgcgtggcaaaccgaagttcaacaagtgggtatgccaagctcaatgacacagccaacttatcagcctcaaccaacttatactccgccaccagcaccgcagccgacctatcagcctgcaccacaaccgacttatagccaaccaagcaatgttcaaacgaactacggcggtcaaagtgaagtggtcggaagttgtaatgtggtaagagatggaagtaatgctccgatttatagccaaattcagaaaggttgctatacagatggcacttataccgttgacaaacacgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacgctctttttagtggcttatttgactgggcaaacacctaatcaaattgctgctttaaataatttgagtacagcaacgccattgaaagtaggtcaagtacttagagtaaaatagttttatttgtaatgacatttgaatagacgcagaggttgcgtctattacgatattgagcagacgctgtagcgttttagacttttttgaacgccctttggcgttttcattttctttgaaggataattgaatgaaaaaatcgtttttcttattaccgcttgcagcattagttttgactgcctgcggttcaaatacgcctgcacctgtggtaaatgcggaaggttctgatttatcacctggcgtaatgcaacctattggtatgggggcaaacaatactaattacggctggcagacagatgtgcaaagcacttctatgccaagcacgatggcacaaccaacttatacacaaccgccagtgcctcagcctgtgtatcaagctccgcagccaacttatcaagcacctcaacccgtgcatcaagttgttcctcagccgataacaaagccgacagctaaaacaacacccgtagcgaaaaagcctgtatcacaagattttactattcctcgtgacgctaacaatgcacctatttatagtcaaattgataaaggcttctataatggcgacagctacactgtccgcaaaggcgatacgatgttcctcatcgcatacattgcaggtaaagatgttaaggaagtcgctgctttgaacaatatgagcgagccttatcaacttggtgtagggcaggttttaaaattgggtaatactcaacctgttgaaccaaaacaacaaactgttcagtcaccaaaacctgcaccaaccccagtagaacctgtagtaacttatacccaagcaccgaacggcactgcttatggctcagatggtacaatgactggtcctgtgaaagcgagtgtaggcactgttccacctgctcaaacttctacaaccccaagagtaaccgcaactgcggctaacaataccccgaactacagctcaacatctgtaccagcagtggcatcgtcaattcgctggcagtggccgacgcaagggcgtgtaatttctggtttctctgcatctgaagggggcaataaaggtttagatattgcaggaacgaaagggcaaccagtaaaagcggctgcggcaggtcgagtagtttatgcaggtaacgcactacaaggttacggcaacttaattatcatcaaacataatgatgacttcttgagtgcctatgctcacaacgacagtatcaaagtggaagaacaagataatgttaaagctggcgaaaccattgcgactttaggtagcacagggacaaacagcaacaaactgcatttcgagatccgctatcaaggtaagtcggtagatcctgctcgctacttgccaagacagtaattatgataatttgaggcatagtagacaaaagtgttggtttttctgcaaactatgtctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaccctgcgggtccaactggaaattcggaattaaaaggcattacgtcgattgccaatggtaacgacgccaccaaggcgaatggggctaagattaccttgtctgcaggttctacaaataaaacagttaatgttaatgatgcgaaaattaccaatgtggcggctggtgtagcagataccgatgcggtgaatgtgaaacagttgaaatctgcgaaaactgaagtggaatctaccgatcacagtgtggtgattaaagagcgtcagggcgataatcagcaaatcgtgtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatagtacattcagacacaggtattttttataatgaatgaaaagtggggaaaaacagctaaaattcactaaaataaaggtccttagcgattaagatcattgaaaatttactgcggttaatattgcattttgtttttttattcaactgctacataatgccgctataagaggctttaagccactttttagtggctattttgtattactccctttccgatacatacaaaggaaaatacaagaattattctatatcctctgattgtaaatccagcaactctggcgataacacaatccctgttaaatccgcatagacataatcttcaggcaaaaaggtcactccaccaaaattgacaggggtatcaacttcacccaccattgagtcatcagcaccaacaggaattggggcgagggcttggataccaatatctagggtttctaatacatctaattgacgtactgcaccattgacaataataccttcccagccattatccacggcaagttgggcgagttctgcatcaattaatgctcgacgcactacaccaccaccatcgactaaaagcactcgtccttgaccttcttcttccaacacttctgcaattaagccattgctttcaaagcattttactgtggtgattttgccgtagaaagatgaaagtccaccaaagctagaaaaaataggttcgacgacatctacttgatcggaataaatatcacaaagttcagaagtatcaacacgcataacttgctccttttttcaattttattgttggaagtataaacctttgcataattttgttcaaatctaaccgctttgctgagttgtattatgttctcgatgtatccgccataacattctggcatcaatgtttgatgatgaaatcattgttagaaaaacagctgctccaaaataaaaggctgcttcacccaccgagaagctgataatttgcccacgttcaaccaaagacatcatcagtgcaaggacaaacaagtctaacattgaccagcgtccgacaaagtgaacatagtgtagtagtttcatctgccagtgaattgggtgtttccagcggtaatggatcgcaagcaacaagtagaaaatcacggcaactttactaaacggcacggcaatactagcaataaagataatggctgcaattaagtaactgcccatttccataaataaaatcaccccgcccattaatgtatctgcggaagttgtccctgcaaattcggtagaggaaatcggcaaaaggttggcagggatcatcatcacaaaaccagcaatcaaggttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcatattcacgcactttaaatgccgccacggcaatcgccacgagataaacatctaacatcacccactgtttcgctttgctgagtaaaatcaaggtgtaacgtggtctgtggcggattagccgttgaataaagatcaataataccaagccagcaaaggcaaaaggcataatcaccgaacagagcaaaatcataaatgctgtgtagggaaaaccttccgtcgccattttccataccccaccccagacggacgcataaatcggcacgcctagtaggtcgatattcatcaacggcaaccataagccaaaaggcaataaaataagaatagataaggcgataatggcacaacgtcgcaagctccaacggttaccagattgcaatacttcattgcaattcgggcaacaagcggtctgattgggtagatcttttgctatgctgacaacgctatcacattcaaggcatcgctgtaagtaaatctcgtcttttttcattctttggttaatcgctgtgcaacaggggcaaaacttttacggtgataaggggttacgcccagactttctaatttttcaaaatgtagcttggttggatagcctttatgctgtgcaaagccgtactcaggatactgtttatcgagttcgtccatttcctgatcccgtgccactttggctaaaatagatgcagcactgatttcagcaacaagactatcacctttcacgaccgcttgtgctggcataggcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgcttgtgctggcataggcaaggttggaatacgatttccgtccactaacacaaaatcaggctgaatacgaagccctgcaaccgctcgttgcattgccaacattgtggcgtgcaaaatattcagctgatcgatttcatctggctctgctcgccctaaagaccaacataatgccttcgctttaatttcttccgccaacgcaagacggcgtttttccgagagtttcttcgagtcggcaagcccttcaatcggctgattaggatcaaggataacggcagccgtcacgactgccccaaccaaaggtccacgcccaacttcgtccacccctgcaatgagctttgcttttggatattcaaacatcaattttcttccaagctataaggaagttcaaataatgccaagctgacattgccgacacggaaattagcttctggctcaagttctttattcagcactacttgtagccaaagctgttgttgataacgctgtaccgctaaaattgtccccgtgcttttccagttctcgcccaactgcatttcaatgctagaggcgatcgctggcagttcgatctcaccttccacattacccacaaaggtaaacatcgcccgtttatttgccccacgatatttcgcacgagccaccgtttcctgcccgatataacaccccttagtaaaggaaatcgctttatcaagctgttgcagattggttgcctggggaattagctcaaactgattagccttgtagagtaatggcacgccctgttgaatatcaatcagattccacaaacgactatcgccattggtttccaccacaatatcgccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagatcgcccgtttaggctcttcgtcaaggtaacaagcggtcacattctcgttaaattttgcaatgatctcaccgcttgtcgttccaaacagagcctgatctaattcggtaaaggtcactttggaaaacaccgcatatttcttcaactgcaccagtgcctcaggcaacagatcttgttgaataatcaggaaaaattgctccgccgttgcacgatataaacggaacaacgcactcatttttcctttcggatcacaatggcaagttaagctctgctcaccaacagcaagtttcgctacatcacaagtaagctgtccttgcagatatttttccgcatcaatcccagctacttcaatcaagcgatattgagttaaagccacacacaactcaggctgttgatgtgtcactttttgacattcacatttcatcttattatctcaaaatagggttaaaaacaggcggatcatacacgatttgcccgatgggataaattgatttgctgggggaaatttgttactccaagctttcccccaaataatcagcacaatcaaggcgtaagcgagcgcagaaaccagctgcccatttagcaccgcatttaccgcaaaactgcccaccaaaggataaatcaacaacagcagattttccgctgccaccaagccgaatgtggcgaacagccgttttttatgttgcaaagcaagggttttgagcgaacggaacattgttggttcgaggggtggctcaaaggtcggttcaagatttgctaaggacatcaagccaccgtatccgttttgtcgatttgctcacggcaaaccgtgcaaaattccgccaacaacgcaaatagttgagcggtctttttctcgcctaattttgcaaaagttttatccgccaactgctgtgtcgcctgccaaaccggttccgccttcgccttgccgtctgcggtcaaatgcattattttttcccgtttatccaccgcactttcgctaaactcaatccagcctttttccttatattccttgcaaacattaaacaccgtctgtttcggcaacagccattcatcgcaaatctgcttttgcgtacactgccccctttccgctgccgccaacgaatacagcaccgcaaaatggttataacccaagcctaatttggagatccaagcgtccattgtggcatctacttcactgatttgtttacctagtttgtcgaagttgctcattgtttaaagtcctaaaaattactaaattgagtgctattttagatgtgagaaagagaaaaggcaagagatattggtattaaaatttgctttttaaaaggcggaatatctttttatcaattgaaaaaatgttatttatattcactttttcattggaaaaagtgtgtttttagcaagattttcgttgataaaaatgtttttgctgcctaaatttaaaggggctttaaccgagcaatatgtgttacaacaattgcttgcaacccaagaaaatcccgttttttattgggcaacagaaaaaggcacggcagaagtagattttgtactacaacgcaaacaaaccgtaatcccgattgaagtcaaagccgaagaaaatttgaaagccaaaagtttgaaagtgtacgtagaacaattccaacccgaacaggcttttcgtttttcaatggcggattttagggaacaggattggatggtgaatgtgccgttgtatggatgcctagcggcttagtttctgttgaatattattgtagaatattaaatcattggcgaataacaaataagaatttctattggataataaaaatggctaaaaaagaaattaaaacagatctttgggtttatgatttattaaaagatgcagaattagatttatgtccgcaaggtagcgatattgctgaattggataaagccttgaaaacggcatccaaagcacaaacaggtaaagcagggtatccagaatattgtggtgttgtgaaagattttgtcattgtaatagaagataaagctgatactgctaaccatatcaagcacaatgataaagatctaatttgtcaaaacgctacaagtgtgagagatttcgctgtaaatggggcattacattatggcattcacctagcaaaaaatacgagttataagaagattattgctattggtgtatcaggcaatgaaaaacgccataagatttcgccactcttcattaatgaacgtggagagtataaaacattggaagatgttgaaacgtttactttattcaatgaaaagaatattggggagtattacactaaaaatatcttaaaagaacagacagatgaagaaaagaccactgctgaaattttaaaagatgccaaagaattacacgaagatctacgtaattacggcagtattcaagataaagacaaaccactgattgtatcgggtattttgcttgccttgcgtgaaattgagtataaaaattttgatattgataacttaaatggtgatgaaattaaaactgatggtcagaaaatttatgaagcaattcaagcaaatttagaccgtgctcaagttaagccacaggtcaaaaaagataaactacttagtcagtttttagttattcgtgataccaaagccatcaatgaaattaattctacattggggaaaactccactaaaacattacactcaatttatttacgaacatatttataaaaacatcaaatatattcactctgcggaagactatttagggcgtttttatggtgagtttatgtcctattccggcggtgacggacaaactttaggtattgttttaactcctcgtcacatcgttgaattgttttgtgaactgatagatttaaaaccaacagattctgtatttgatccttgttgcggtacagctggctttttgattgccgctatgcaccatatgctacaaaaaacagataaagaaacagagaaaagaaaaattcgtaaagaacaattacatggtatcgaattgcaaccttatatgttcactatcgctacaacgaatatgattttacggggtgatggtaaaagcaacttggagcaggaagattttcttaaacaaaatccagcacaattacaactcaaaggctgtaatgttggcatgatgaatccaccgtattcgcaagggtcaaaagctaacccaaatttattcgagatttcatttactgagcatctacttgactctctaaccgcagacggcaaagccattgtgatcgttcctcaatcatcaatgactgggaagagtaaagaagagcaggcaattaaagaaaatattttgaaaaagcatactcttgaaggtgtgattaccttgaacaaaaatacgttttatggtgtcggtacaaatccttgcattgctgtattttcaacaggcattccgcatgaaaaagataaaatcgtcaaatttatcaactttgaaaatgatggttttgaagtgcagaaacatattggcttagtagaaacaatcagtgcaaaagacaagaaacaacatttgcttgatgtttggtttggacgtattgaagcagaaagtaaattttgtgtagaaacgactattgaagccgatgatgaatggctacattcgttttactactttaatgacgaaatcccaactgaagcggattttgaaaaagtcattgccgattacttgacctttgaagtcaatatgataacgcatggtagaggatatttgtttggattggggaaagatgatgagtgagttgaaattgacggatagaacgtggggaaaattttcgattggtgatttgtttcaaatagaaaattgtaaatgttccaaagtaagtgtattaaaagaaggaaatgtaccatatataggggctactaatagaaataatggtgttttatcttttgtggaaaataaatcctcttttattacaaaaggtaattgtattgtttttatttgtgatggcgaaggttcaataggttattctatatataaaaaggaagattttattggaacaacaacgataaaagtaggaagaaatgaatatttaaataaatatatagggcagtttattgttacttgttcaaatatgatgagaggaaaatataattttggttataagaggaatgaagccaatcttaaaagagaaattataatgctacctgaaaatactgacggagaccccgactggcaatttatggaagactttatcaagcaaaaagaagaaaaacaggttactgagttgaaaaattactatgcggataaagccttagagttaatgatctcaacaggtaatttgagaaatacagaatggagagaagacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttacacaaattgtgggagaggctctggagagaattttccttttctcaagtctttgttgaaattcaacgaggtaagcgtctaaccaaaagtaatcaacaagacggaacaacaccttatgtttcatctacagccactaataatggtgtagataattttatcgacaactcaacaaatgttcgtatatttgaaaattgcctgactttagcaaatagtggcagtgtgggttctaccttttttcattattatacttttgtcgcaagtgaccacgttacagcattaatactggaaaagccaaataaatacatttacttgtttttgtcgggaattattaaacgcttagaagaaaaatattcgttcaatcgagaaattaacgataaacgaattcagcgtgaaaaaattttattgcctgttaatgaagatggattgcctgattggcaatttatggaaaactttatgaaacaaattgagcaagataaaatttctgttgtactcaattattataaaaaccttttaataacaataacttgcggggggggggtagaagcatgtctactatctaaaaatggttggtcagaatttgctatacaggatgtttgcgatattgtctcagggcaggatatttatgaacgtgaacgaatagcggggaatactccatatattacagcaacagcaaataataatggaattggttatttcatcgccaataaaaattcaacgttggaaaaagattgtatctctgtaaacagaaatggctctgtaggttatgctttctatcatccttatgaagcgttatttggtaatgacacgcgtaaacttagacctaaacatgtaaataaacacacttctttatttcttacagtatgtattgagaaacaaagaattaaatatggatatggttataaaatggggactgagcgtttaaaaaaacaaaaaattcttttacctgttaatgctaataatcaaccagattgggaaaatattgaacgttatatgcaacaaattgagttggaaaaaattgtatgttatttaaagagtaaacattattcctaataaatatatgaaaaggtcgtctgaaataaattttcagacgacttattttttgtatacttacgaatagactaaacaagatttcagtaaggagcttgtatgaccaaatcagaaattgtttcttcagtggctgaatatctcacctttatgaccgctacaggcgagagccaagtcaatgccatttatgcggacgaaaatgtctggttgagccaaaaaatgatggggcagctttatgatgttgaagtgcctacgattaactatcatctaaaaaaagtatttgatgataatgagttagacgaaaattcagttattagaaattttcgaataactgccgatgacggtaaaaattaccagaccaaacactataatctttcggcgattattgccgtgggctataaagtcaattccgagcgagcggtgcaatttcgcaaatgggcgaccgagattattcaaacttacaccatcaaaggctttgcgatggatgatgaacggttgaaaaatgacggcacacgtttaggcaaaaagtattttgaagaacaacttgcccgtatccgagaaattcgcctgtcggaacgcaagttttaccaaaaaatcaccgatatttatgcgacttccattgattacgaccgtactgccaccgcgaccaaacgtttttttgccacggtgcaaaacaagttacattgggcaattcacggtcataccgccgcagaattgattgtggaacgagcaaacgccagcaagccgaatatgggcttgaccacttggaaagacgcaccgcaaggcaaaatttaccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtggtagcgaaaaattatttatccgacaacgaattggctcaactgcaacggttggtatccgcttatttggatatggcagaagatatggcgttacgccaaatcccgatgacaatgcaagattgggaaaccagactcaaccgctttttagacgctactgaccgagccgtgttacaagacgctggcaaagttaccgccgaaatcgccaaagcccacgccttgagcgagtttgaaaaatatcgtgttattcaagatcaacattttgaaagcgattttgaccgcttgttgaaaggggaagggtaaaagagtggtaggttttggggagatttggtatttttgctggcatattattcggaggtatcacttattggcttgttgggttattttcatctagcttagctatagctgctggaattgcaataggtgtgatattttggattgtgacaccatctgtaaacaaaatgcaataactaagttaatatgtaatgcttccaatatgggggcattacatctcagaccgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtcaagacccaccctacaagctgattatctatttatttgcaaaatcttcatgagagaataccgcttatttaattaccaagtggtataaaacaaatagatatttctaaataccacttataatattacttcatctcagccaacgccaaatccgccatttcaagcgtataaacaatatcttcgtcactatgtgctaaagacataaaacctgcttcaaaggctgatggtgcaagatagacacctttttctaacattttatggaagaaggtattaaacgcctttacatcacatttcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttacatcacatttcatcacatcttgatagctttcgattttggcttgttcggtaaagaatagaccaaacataccgccaacatactgaactgtcattggaataccgtgtttatccgctaaggctttgaaaccttccgcaagggttttggttttctctgcaagcagtcgctcattacctgcttttgatagctccgttaagcaagccaaaccagcggacattgcaattgggttgcccgaaagcgtacctgcttgataaaccagaccggttggggcaataaattccataatctcttttttaccgccaaatgctcccactggcataccgccaccgatgattttaccaagcgtggttaaatctggggttacgccgtagtaactttgagcaccaccaagtgcaacacggaagcctgtcatcacttcgtcaataataaataccgcaccatattgagtacagagttcacgcaagccttgcaagaagccttcttttggcggaatgcagttcatattaccagccacaggctcaatgattaaacaggcaatgtcgtttggatattgttcaaaggcttgtttaaccgatgctaaattattgtattcgcaagtgagtgtatgttttgcaaaatcttcaggtacccctggagagcttggctgacctaaggttaatgcccctgaacctgctttaactaatagtgaatctgagtgaccgtggtaacagccttcaaatttaataattttgtcacgtttcgtatagccacgagcaaggcggatagcagacattgtcgcttctgtgccagagctgaccatacgcaccatttcgattgacggtacgagtttgcaaactaattcagctaactcaatttcaatggctgtcggcgcaccaaaacttaatccgttgggtacggctttgagcactgcctcaataatggctgggtgattatgtccaagtaccattggaccccaagagccaacgtagtcaatgtaacgcttgccttcgctatccgtaatataagcacctttggcactgtcaataaacacgggtgttccaccgacacctttaaaagctcgcacaggcgagttcaccccacctgggataacacgttgtgctttttcaaaaagagattgagatgttgtcataagaatccttaacgtgaatcacgtaaaatggagttattttactgtaaattacgctttctgcgtgaaaaaaattgagtgtttcagcggttatgctatgctagccagcattttagttttcccttattgaaaggataaaccgagtatatgtggctgacatttattgctgtatttttggtttcttttatctcacttattgcaatgcgtcctgtggcggaaaaaattggtttagtcgataagcccaatttccgtaaacaccatcaaggtgtcattcccttaattggtggtattgccctttatcttggcaatctcgctttctacttattggaatgggaacagatgcaattgccagagctgtatttgatcgcattaaccattttgttaatgattggcgtgttagatgatcgctttgatcttagtccatttctgcgtgcaagtatccaagccgtactcgctggggcaatgatttacagcggtttatccattgaaaacctagaacaactgaacgctccttttagcttggaaattggggcattaggtgtcgtactaaccgtctttatcaccatcggcatgattaatgcgttcaatatgattgatggtattgatggcttgctcgcaggactttcttcggtaagttttgctggattaggcacattaatgttacttgacgagcaatatacgctagcctattggtgctttggtattatcttggtgttactgccttacgcaatgtttaatctcagcgtttttggggcaaaatggaaagtctttatgggcgattcgggcagtaccctaattggttttaccatcatctggattttactactcagcacacaaggacaaagacaccccatcagcccaataacaggtttatggctgattgccgtgccattaattgatatggttgcggttttcttccgccgtttgaaaaaaggtaaaagtccattcagaccagaccgcttgcatattcaccatttgatgatgcgtgcaggtttaacctcacaccaagcgttagcggtaattacctttggtgcagggctttgtgcgaccttcggcgtaattggcgaagtttattactggaaccaatgggtaatgtttgttgcctttgtttcccttttctttctatattcttattctattgtccaggtgtggcgaattactcgatttgttcgtcgccacaaacgccgtgcaagaagaaaacagactgtttagaggctaaaaatgagcgagcaagttcaaacacaacgttctagtgtaggactattttttacatctttatttttattattaatactttctgctattggcggtgtagcgggttggtttggtgcaacaacgcaaacagcttattggaaagctgaggcacaatttgaagtccctaaagatcaactgttatgggcagccattggtggcggtattgggttactgctaggctttttcgttgtgttgttcattaatcgtaagaaaaactagcttgtggcatatcgtatcttagcggtctttggtactcgaccagaggcaataaaaatggctcctcttattaaaagattgcaacaggaagaggcttttgctattcaagtttgtgtaacaggacaacaccgccaactactcaatcctgtgttatctttgtttgatattcaacctgactttgatctaaatatcatgaaatcagggcaagatctggcaaatattacaagccgtattttgctaggagtaagtgaggtgttgtctcaatctcagccagatcttgttttagttcacggcgatacaactaccacatttgctgccagcttggcatgctattatcagcgtgtaccgattgcccatatcgaggcaggactacgtacaggaaatcgtttttccccttaccctgaagaagctaatcgtcatttaaccagcgtgttagccaactatcattttgccccaacagataaggctaaagctaatttattggcagaacatcatgcagaagatcgtatttgggtgacaggaaatacggttattgacgctttaatgatgatgtcgcaaaaaattacacaaaaccgaccgctcacccaacagctacagcagcagtttccctttttagattcacataaaaagctgatcttagtcacaggacatcgccgagagaacttcggtgatggctttgaacggatttgtcatgcattacgaatattggcagaacagcatactgacatacagattgtctatcctgttcaccttaatcctaacgtaattgagccaacccaacgtttgttagccaatattgataatctctttttacttgagcctcaaccttatttgccttttatctatttaatgcaacaagcctatttaattttaactgattctggaggtattcaagaagaagcacccgcattacagaagccagtgctattaatgcgagaaatcaccgaacgtcctgaagctgtgttagctggcacagtgaagttagtaggaactaataccgagtatattgttcaaagtgtgaaggcattattaaacgatccacaacaataccaacaaatgagccatgctcaaaacccatacggtgacggtaaagcgagtgaacgtattgttgcggtgataaaacaacttgcacaaggaacaatgtaatggctgtatttgaaaaaatagtcgttgtaggactgggctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcggtttacctacagcagtggcttttgcacttgcagggctacaagtgattggcattgattgcaaccctcgtgtgatcgaacaaatcaatcaaggtcgaagtcatctacatgaacctgaactagctcaagctgtattacaagcggtaagttcagggcatttttatgcaagcacggaaccaacctttgccgatgcatttattattgcagttcccacccctctacaggcgaaccgtcaaccagatgtaaccgcaatacaatcagcagtgaaaagtatcgcaccctacttaagacaagggaatttagtagtattagaatctacctctcccgtaggaacaactgaacaacttgctcaatggattgaaaaagaacgccctgatttatctattcccacagatgtggcggtcgcttattgtcctgagcgagtattgcctagcaatatttggcatgagctctatcataacgaccgtgtaattggcggattgaccccgaactgcatacaacaagcggtagcgttgtatcagctttttgcaaaaggagaatgtattactactgactctcggctggctgagatgtgtaaactcactgaaaacagttttcgagatgtgaatattgcttttgccaatgagctatcaatgatttgtgatcaactcaatgtcaatgtttgggagttgatccgcatagcgaaccgccaccctcgcgtaagtattttacaacctggagctggggttggagggcattgtattgctatcgatccatggtttattgttgctcaatcagaacatgcacgcttgattcgtactgcacgagaagtcaatgatagtaaagctttttgggttattgataaaataaaaagttgcctagccgaatgtgccgttgcaacaaatcgtaaaatttctgatctgacattagcttgtttagggattacctttaaagctaacgtatccgatctgcgagagagcccagccctagcaattacagaatactttgccgattggcatcagggtaaattatggctggttgaaccacatatagctcaattgccagcttcccttgcagaaaaagtagaatgggtggattttgctcaaggtatcacagcggatgttgtcgtgttcttagtagatcatctggcatttcagcaacatgctaaaagacatctatctcctacatggttggtggatacaaggggagcgtggacagattaatttggtttattactcagattaagtgaaagagcttgtatatataaagcaatcatctacaattcactttatcttgaagggagaaaattatctatgtttaaaattatttttacactcttttccttgagtacattttatttgccagctaccgcaagcctatttagctcacaacctaaatttctacccggcgatcaggcatttgcgttttcatctcaacagcaagcggatcaactgcaactcgcttggcagattgccgatggctactatctttataaaaaagagatcgccatttcgtcaaacaatgccaaactgggcgagccaaaatttccaacggcagagcgttaccaagatgagttttttggggaagtagaaatttatcgcaatcagctaacaatccccgttgcccttgaagcgaatgcgactgggcaagtgctggtgcgttatcaaggttgcaccaaaggcttttgctatccccctgaagaagtgacccttgatttacaagcggcgacttccgctgataatgttgcaaaaaataccgcagatgttaccgctatttctgtcgctcaacctaaagccgaacagaaccaacttgccgaaaccttagccgaaaaccgccttgctattttttggttctttgtgctagggctggggcttgcctttacgccttgtgtgttaccgatgttgccactactgtctgcgattgtgatcggcagtaaacagcgtccgaatagcctacgcgcgtttttgctcagtttaagctatgtgcaaggaatggcagtcacttacacgctcttagggctactggttgcggcgattggcttgccttttcaagtcgctttgcaaagtccgcctgtactgattgggctttcgttgctctttattttgctcgcaatgtcgatgtttggtctctttaccctacaacttccacaccgttggcaacaaaaattaaatcaactaagccaacagcaacagggcggatcgttttttagcgtatttgtaatgggaatgatcgcagggctagttgcttccccttgcacatcagcacccctatctggtgcattgctctatgtggcacaaagcggtgacttactgacaggcggtttagctctctacctattagccttaggaatgggcattccactgatgttagtgacccttttcggcaaccgcattttgccaaaatcgggggattggttgctgaaagtaaaaacgctgtttggcttcgtaatgttggctctgcctgtctttttgctctctcgtgtgctacctacttttattgagccactgctgtggtcggctctggcgatagcctttttactctggctaaatgagcagtgcaatagtttgaacggctggaaaaaagtgcttcgtttgcttgtattggcaaccttggtagttgcgagcaaaccttggctagatcttgcgtggcaacctacgttggcaaaccaaacccaaagcaaccatttcaaacgcattcactcccttgcagaattagagcaacaactggccgctaacaaaggtaaaaaagtgatgctcgacctgtatgccgactggtgcgtagcttgtaaagagtttgaaaaatatactttcgttgatccaaaggtgcaggcgaaattggcagaaatggcagtgttgcagatcgatatgacaaaaaattcccgtgaaaatgatgaattgatgaagcattttcaagtgctgggcttgccgactatccttttctttgatgagcaaggcagggaattgagccaatctcgtgtgacaggttttatgcaggcaggtgactttgttcaatggttaaacggattaacacaatgaaaactatcttaattacaggctgttcgtcgggcataggttatgcaacagcccattatctcaaacaacaaggctggcgagtaattgccagttgtcgcaaagccgaagatgtacaacgtctgcaatttgaaggctttgaatgtgttgaacttgatgtgactaactcagcccaaattgcccaagtctttgattatattcaacaaagcggtggtttagatgcagttttttgcaatgcaggttatggacagccagggacagtggaagacattccccgtgaagccttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgaaatttttgaaaccaacgtatttggggcgtgggaagtgatgaactacgctttaaagctatttcgccaacaaaatcacggacggattttaatcaacagtagcattttaggctttgccgcaatgcactttcgtggggcttacaacagcactaaatttgctttagaaggtatggcagacacccttcgccacgaattgcacggctcgaatatctatgtcagcctgatcgaaccaggccctattcaaagcaaattccgccctaattctgtggtgaaattacagcaatatattgatatagaaaattcattccacaaagaagcctatcagcaacagttggcacgcctaaataccaaaggaaatgccaacccctttacgctaccagccattgaatgcgctaaagtttgtttagacgcactcaatgccaaacagcccaaagcacgctatcaagtgaccttcccaaccaaactattttggtggctaagacgcattctgcctaccaaagcctttgatttttgttgtaggaagggtgggggatgatagtagaaacttactgtgattgatgctttttacgttagttttctcatcacaattgcaaccatatgaaaatggcacttttggattgatgtattaaataaatcctttaatagccctctacgtccaccatttgtaatggattgaattctatggcttttttcacgaagtatgttcaatgcgagtttgtaaaggacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaagccatttttaccaacacttttgtctactatgccgataattacttcccaatacaaaaggaactaaaaatattaccgagtaaatcgtctgaggtaaattgccccgtgatttcgcttaaggcattttgtaccattctaagttcttctgctaataattcacctgcatagaactgagttaattgaatgtgtcctcgttccaaatgttctgccgctgtttcaagtgcaactaaatgacggcggcgagcaataaagccaccctcagtagaactttgataacccattgatttttttagatgttctcgtaataaatccacaccgactttagtttgtgctgacaggcgaatcacagtgaaattatctgcttgaaccaaactttctgcttctcctgttaaatccactttattacgaataacagtcacgggaatgtttttcggcaacttcgctaaaaatgtcgcccattcttgttggaaactatccgcttgagattcattgctatcaatcattaataaaacgtggtcagcctgttcaatctcgtcccacgcacgtttaatcccgatcttttctacttcatcactggcttcacgcaaccctgcggtatcaataatatgcaacggcattccatcaatatgaatatgttcacgcaacacatcacgggttgtcccagcaatatcggtaacaattgccgcttcacgaccagctaacgcattgagtaagctagatttgcccgcattaggtttacctgcaattacaactttcataccttctcgcaaaattgtaccttgcttagcctcctgacgaacattagcaagttgagcgatgatctcattcagttttgcttcaattttaccatcagctaaaaaatcgatctcttcatcagggaaatcaatcgccgcttctacataggttctcaaatagataacagaatcaaccaattcattgattttattggaaaattcaccttgtaatgattttagagcggaacgagccgcttgttcagaggttgcatcaattaaatctgcaatggcttctgcctgtgcaagatcgagtttattgtttaaaaaggcttgttcagaaaattcacctgctcgagcaatacgaaccccttttacttttaaaatgcggttgagtaagaggtctaaaatcacttgtccgccgtgtccttgtagctcaaggacatcttccccagtaaacgaatgaggggctttgaaaaagagggcaataccctgatctaacacggtcccatcttcatctttaaaaggaagataatcagcaatacgaggcttagggcatttacctaagaccgcttgtgcaacctctgtagcgagaggcccagatactcgcaaaattccaattccaccacgtccaattggagtggcttgtgcagcaatggtttctttcattctaaataagttgagtataatgagaatagtgtattgtaccccataaaagcggtgagattgagataaaattttactagagttgagattagacgaaaggagaaagccatttttagtgtagatatctactcatgtaaattcttgtgatctagttcacatttataacttattgatattgagaggattatctataatttattatggtatagcttctttcatttatcaggaggttatatgttaaatctaactcgtcgttctcttctattagggttaggtggagctgcagctctagctatcacaccatctattgcgaattcagcagggtttaaagtacgttctgctcaatatagcactaaagatcgtcaagtaggtctagcttatgctcgttctaatgatggtatcctgtgggaaaaaacctaagttgggcattgtggattttgaagggagtaaagagaacaatattattatgcgagatgtggcaggaacaggtattttatatgaaccaacggaagttgatccaaataaacgttttaaattaattactcgtaaagaagataataagaaaatggcggttgctttctcagcagatggtatacatttctcgccgttagttgagtggaaggaaaatagcccaattttgggagctgattgccacaactctgtttttaaagatagtcgtactaatcaatatgtgctgactactcgtttataggcaagtaactttcgggttctggctatctcacgcagtgatgattttattcactggtcaccattggaagaggtgatccgaggtcaagggtatggtgaacaaacttactctatgacggtatttgaatataatgatatctatttgggactggcatctatttataaacaaggtgacaattcagtgatggattttgatactttgaatttagaactgtactggtatacaaatttgacggaatggaacaaagctgtacctgaacataatatattgattcctgctggagcaggcagagagaaataccttgatggggagtttgatagtgcaacaatatttgcatcgtccatgacggcaggagataaccgtatttattatatgggagggaaaggtcgacatcgaggttggcgagagagtggactagggcttgcatttgtagataaagatagacttgcagggatggttgctcgagatccagctaaaccaatgcgtttttcgacccaatcatttaagttctttggagaagatctttttattttggctgatattgaagctaatggcagtttaagcatcgaagtagataaaaaagaggggttcgaattcgcaaatgcagagttgattcaggtagataatggatattatcaggtacgttttaaggggcaatcattggtttctgcatctcaagaaaaaggtattccattttcaatcacttgcatcaatacaacgttttgggggattagagggaattttgaaatggatgagactcgttattggaagggataaatatgtatataaaaaagaaactcagaatatacaatcttttaattatatattaacaagcgtatagtctataaaggctaaccattttgtttgatagtagaaaaaaagtgttattaaagagttaaatccttatagtgcaaagttttaagccctcttttaattaaatctattgcaaatgatagatgtagagggctattcaatacatcaatccaaacgtatcactttcatgtggtcatcattgctatgggtggttaaatttttcttctgacagtaccgcttacgaatctacaacagctttaggatccgcaccgtatttattttcaaaacgatctccgtcaatgaagaagagtaacagatagaaaataacagtgataattaatactacaataataacaactgctttcagcgttgaaaaatgattgtttatgacatcttcaatattatatcctgcaatgactagaacaattgacatggctagctgacaaagttgccaccaacctgaacaacctagatcatgtaaacggcgagtaacaaggctgattgatggaataatcaaaatcaatccaaacaatagatttaatccattgagcagttccgccaaactaaacattcgtaatacagttgcagctgagctaaataatgaaaaacagagatcaataagaatgatgattaagataaaccagccatactctgctcgtcttgctctgcccttaaaattaaagctgttttttagtgcgtgaataaaccatttcattcattttcctcctttggttagattaaattttgtgaataatgaggtttatttttccacttgtaaacttcaatatgtggattattcctaataattagctatgaagagggggttagatagcttatcgcataatctaacgcatagtcgtaaccttttgcccctaagccacagatcaccccttttgccacatcgctcaaataagagtggtggcggaaaggttcacgggtgtgtacattggatagatgaacttcaacaaaaggaatagcgacagataataaggcatcacgcaaggcgatgctggtgtgagtaaatgcgcctgggttgataataataaaatcaactttttggaagctttgatgaatgcgattaatcaaaggttcttcaccatttgcttgaaaatagtcaaacgcaaagccttgggcttctgcttgttgttttaaatgttgctcaatatcagataacgtttgtgaaccgtagatatgaggttcacgctttccgagcatatttaggttggggccgtttaacagtaaaatggtttttatacattctcctataggatatttgtatttaatttatgtaccaataataacattacatattaaagcatatttttagaaaaaaatactaatctaattaaagttgtttctgatttaaagttcttatttattccgataatatctttcaaatcagtaggtagcagagggttattaaaaggaagggctattgtagactttagataacctattttatttttaagaattgggcggttaggataaatgatggatgtaaaaaaggcaatatatttgactatattgccattaaagataataacggtattatgcccaatatttatcaatttccgcacgaattgcttcagcggttgctttacctttttcaccgactaaggcacgacctgcgatgaaggctttggcatttttaacttctttgaaaagatgaatttcttcaggaacgataccgcctgtaatggatagttctaaaccttttgcagaaagttgtttcattaattcaatatcttctgctgtccagccttttcctgctaattcagcatcgcgtgagcggtggtaaatcgcttgtttcacgcctaaatctacccactcttgtgcgtctttttcaacggtccagttgccgtagatttcgatttgaatttcttttttcacttttaattcagggtgagcggcattaaattcatctgccacttttttacaagctgctttagttgcagggtgagccgctgctgaaactgttagccagtccgcgcctgcttcaaatgccattttggcaaggattgcaccgccatcggtggtttttaggtcacatacgatgatgtggtttgggtgtaatgctctgagtgttgaaatggctttcataccttctgcacaagctaggattgtgccacattcgataatatcgacaacatcttctgcttgtttggcatcagcgacggctttttctaaacttaaagagtcaagggcaatttggagaagtggttttgacatattattttccttttaaagattaaaaattagggttgcaagcggttagatttgagaaagaaatagcgaaactatataaatattaaaacaacattgtagggacgccacgcttggcgtcctttaaatatcatctttactatatttgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttctcttgtgtgctgaatatttaccaaaaacaacgttttcccaaccgcttgtatgaattagccgtttaatgctgcatcaatcacagcatacacatcttctgcggttttacagcggcggattttatctaaatcaacgcctgtgtcgctatctggatcatcaagcacttgggtgatttccattaagccttgcatatgttgatctgagtcgctacctgcaagggttaaaagtacatcaacaggctcgtcttcaccttcaaaatagattggtgtgtcaagggtaacaagtgcaaatgatgttttgattaccccttcttctgggcgagcgtgtggcattgctaaacctggtacgagaatgatgtaaggtcccatctctttgattttgcttacaatattgtcgtaataacgtggttcgattgtgccagcggtaacaagtaagtctgtgccgattttgatagcttcttcccagttgcttgcggattgatgaagtttgattgagttattttcaattaaagattgttttaaattcattgtacacctcttggataaattcccccctttgaaaagggggggttgactaggttacttagcgttatgtttattgattaactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagtccgttacggcacaagagtccataatatttgggataccacgtttatctaagtagcctttgatcttcattttcatcatcattgatgaaccttgacctgagccacataccgctaagatacgaactggttttgcatcactttgagcaggtgatacttctgctttttcttctacttttgtttcttgttgagtttgaacttcatctaagccgtagccgtctaattgttcaagtgttaagccttttgctgcagcttctgcttcttcagcgcgtaagttgcgagaagcgaagaacatataaaccatcgctagagcaacaatgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccatcgctagagcaacaatgatgaagaagaagcctggtacgctaatgataccttgtaggattggtgggaagaataatgcccagtcagccatacccatccaaccgttgaaggttgtaccttggcttgctaacatttggattacccacgcagaacctaatacttcgatcatacccatcacgaaacagattttcattaccgctttccagccaccgaattggtttgcaaatacaccgattgttgcgttagagaagaacatcgggataaagcctggaatgatgagaattggtgagccaaagcctaataggatacctaccgctacgaattgaccgattgcaccccacataaagccgaataccattgcatttggtgagaaagcatagattgccgcacagtcgattgcaagtactgagttcgggattaaacgttcagagatacctttgaatgcttctgaaagttctgcaacgaacatacgcacaccagttacgatgatttgaattgctactgcaaatttcaagcccatttcaagaatgtacataaaccagtgggttttacctgccatttgttgcaagttatctaaaccgaatgaaagtaagatgataccgaagaagattgtcattactaacgcggttgcagagatactgtcgtggaagatatgtaaccattttggtaggttcatatgatcgactgagtcatctttgttaccgagtttcggtgcaagttttactgcaatccaagacgcgatttgttgttggtgaccgatagagaaacctgcaccgccagtaaccgcttgtgttggtttatatataatgttagaagagataccccagtagagtgccattaacacagaagtatagataatggtttcccacatagaagcaccgatgatcatatagaacaccgcaacaagacctgcttgttggaacataatatgacctgtaagcataatggtacgaataccagtgaattttctaaataccactaataagatatttaataataatgcaccgataaccgcataaccaacccaagcatagttatccgccattgtttgaatggtcgcttgcatactggtgtaagggtcgattaccgcacctgttaaattatggaatttagataaaccttcgataacgggtttgaagttggttacaaggaaacccgaacccgcttgtacaatcataaaaccaacaatggttttgattgtccctttaatcacggtagtggtgtcttttttcagaagaatgtaacccaagcaggctacgataccaagtaagaatggtgctttatttaacacctgatcttttaaaaagagcaggatatctgtgagcatttccataagagtacctcttattttatcaataaatatatggagaaaaattgctctcagcgcaatgctgagtgtcgaaattccgataagtacgaatttaacatcgtgcataatagcaatttcatacgactaaaaaagattgaatttgattatttgcgaactatgtcacattatttttgtaaagaaaagttgttattttttacaaatgtgaggtggacaaaatatgcctttgttaataaaaacgttactcttataaatatattctatgtttttcaatatgttgtagatgacaaaggttatcaataaataacgtttacataaaaaattagatatagatcacaaaattacaaaaaagagtgtacatttttctgtgattggttatgattacttgtgattattttattctttcctaactttgttaatcataggagctaacaatgagcaaaatttcagaaatcacccgtgaaagttggattctttctaccttccctgaatggggtacttggctaaatgaagagatcgaaaatgaagtcgttccagaaggtaactttgcaatgtggtggcttggctgtgtgggcgtgtggattaaaaccccagcaggtgcaaacatttgtatggacttatggtgtggtcgcggtaaaagcaccaagaaagtaaaagatatggtgcgtggtcaccaaatggcaaatatgtcaggtgttcgtaaattacagccaaacttacgcgctcagcctatggtgctagatccatttgcaattaatgaagtggacttcattcttgcttctcactaccacagtgaccatattgatgtgaacgtggcagcagcgattgtaaataatccaaaattagatcacgttaaatttgttggtccgtggcactgtgcagagctttggaaaaaatggggtgtgccagaagagcgtattatcattgtgaaaccaggcgatgtggtgaaattaaaagacgttgaaattcacgcattagactctttcgaccgtacctgtttagtcaccttaccagtagaaggtgcagaagctcaaggtggagaattagccggtctttgcccatcagatgaagaaatgggtcgtaaagcggtgaactatgtgtttaaaacaccaggcggtaacatttatcacggtgcagactctcactactctattcaatttgcgaaacatggtaaagagttcgatatcgatgttgcattaaacaactacggtgagaacccagtaggtatcgcagataaaatgacctcaatcgatcttcttcgtatggcagagtgcttacgttgtaaagtgattattccagttcaccacgacatctggacaaactttatggcaagcacccaagagatcattgacttatggcgtatgcgtaaagaccgcttacaatacaaattccacccattcatttgggaagtgggcggcaaatatgtttacccacaagataaagacttaattgaatatcaccaccctcgtggttttgatgactgcttcgagcaagaaccaaatattcaattcaaatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaacgtgagtgaaatagaccgcgagtctggtttagttgccgttaaaccatctggcgtagattacgatgtaatgacagctgatgacattgtgattgttgatttacaaggcaatcgtgtctggggaacgaaaaaaccgtcttcagataccccaacgcacttagagctttatcgtcaattccctgaaattggcggcgtggttcatacacactctcgccacgcaaccgcttgggcgcaagcaggggaagatattttggcacttggtacaacacaaggcgattacttctacggctctgtaccttgcacccgccgtatgaccccagaagaaatcgcaggcgaatatgagttggaaacaggtaaagtgattgttgaaactttccgtaaacgtgcgattgagccatcaatggtacctggcgtgctagttcactctcacggacctttcacttggggtaaagatgcatttgatgcggtacataactcagtagtattagaagaagttgcctatatgaattttgtcagccaccaaatccgtccgaatattggttcaatgcaacaagaactgttagacaagcattacttacgcaaacacggtaagaatgcgtattatgggcagtaataaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcccgtaatataaggctttaagccattttttagtggtcattttgtctactatgccatttttccctctcgagaaacattagcctgcctataaagaaaactgttaaatatctcccagacaattaatatactctcacttttggtggagtataactttgaataaaactttcaatttctgccaaattatctgaaaacagtgttttgtttctatccgcttgagtgagaaagccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtgagaaagccttgttttaccatattgtcaaaaaaggcttttaaatcatcataatagccatcactattaaacaaaatacacggattggggttttgaccaattctcgcccacgagatcacttcaacgatttcttctaaagtacccggtccgcctgctaacgcaatataagcgtcacctaattctatcattttgctcttacgttcaggcatagaattgacggttatcatctgcgtcaagcctttatgcgccaactctctttcctgtaaaaaggttggcataataccaatcacttcaccgccattttccaacacggtatttgccaataagcccatcaaccccgcgttaccaccaccatagactaacgtatgttgatgctctgcaatccatttacccaatttaatcgtcgcttgttggtgagccaaattattcccgacacttgctccgcaatagacggttattttcatttctttttcttcctgttttgttaaagtagtggcagatggtaacaaataatgagagagaacaaaatgcactttcaagaatatcaacaatgggtcagggaattttatcaacagcagaattggtacgagcgagatgtttttcgtcgccttgcttatctgactgaggaaattggcgaggttgcctgtgccgtgcgtgctattgagattggtcgagagcgtcctgatgaaattgagcaagatgccttacagaaaaaagaaaacttaattgaagaattgggcgatgtgtttgataacttatttatcttagcggataaatacgatattgcgattgaagatgtgattgctagacatcaacaaaaatttactaaacgttatcgtggggaataaacaagcggtcaaatttgcaaatttttttacaaatctcaccgcttgtatctcttatttctctgaagagaaaccggatttcaccccgtgcatatttggcaactggtgagcaatccctttatggcagtcaatacaggttttaccttcttgttcagccattgcgtgcatttttgccgccacatttttttgctgagtgaagtccatatcgctgaagttatggcagttacggcactcttgtgaattgttggctttcattctcgcccattcacgttgagccatttctaagcggtgtgcttcaaatttctctttggtgtccactttgcctgttagatgagcaaaaacttcacgagatgcgacaattttgcgtgtccatttcggaataaattcgtgcggtaagtggcaatctgcacagtccgctttaacaccactgcggtttgagtagtgagcagatgctcgatactcaggaacaacatcattcatatgacagcttgaacaaaactcttctgtattagtgtgctctaatgctgtgttaaatccaccccagaataaaataccgccgatcgcagaaacgacaatgagaaaaccgatgccgattttgcttggggttttaaaccacgtccaaaattttttgatgagcttaaacattatttacccccaaatgctttggtcggttcaaattggttttcgataattggatcaacatttgcttgtggaacgtggcattgtaagcagaaataacgacgtggtgatgtgtcaccagttactttgccgtcacgatccataaagtgtgttgggctaatgcgtggcgcgcctgtggtacggtagttctctacgccgtgacagtttaaacattggttggtgtttttggtcacttggtagcctttaatgctatgtgggatcattgggggctggttcacatagctaagcggtaactttccttcatcttttggcatattgtggaaagctggctcaatcgcttcaacacctttatctggacttgacgggactttttccacattcgcaaaagccacacctgttactgcgattaataatagggcgagatattttttcatttttcactccgttcacgttcaaaacgtgttgtaaaactaaatacattttctgcacagacatcaacgcaacgtccgcaactaatacaatctttagataacactatttggctatcttcgggcttaccgtttaagggtaagcgtagtacctgtggttcagggcaaacgtggaaacaatccatacagcgatcgcatttcgcacgatcaacaacccttactcgtacaatgctttttgcaccgattaaaccgtaggttgctccgattgggcagagatgtccgcaccaaccgtgttccacaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataagaaaaccgctaacactaaccaaagcgttgcaccaagaccaaagacgaacactcgaccaagtgctgcaacggggttgatccattcccataataatgtgccagaaattgctgatccgactaagatcatcgctaaaataccgtaacgtaatgaacggggtaatttagcagattggcggatccccagttttcgtcgtagccaagcggcacagtctgtgacgatattgacagggcaaatccagccacagaataccttgcttgcgagtaaggcatatattgccacaataatcgctgcacccagtaaggttttccattcaggcaaatagcctgtggcaagactttctgcggtaatcagaggatcggttaaagggataagatcaaacagcatacttgagctgtaattgccttttaagatccacacattccacatcggaccgcttaagaacatcaacaccacactaagctggcttagtcggcgtaaaattaaaaagcgatatgcacgccaccaaccgagtttttgtcgggcttcaagccctgcatctttcggggaatttgccattacttcaccccctctggcattcgtgttggtagggaaataatgccttctgggttggttttatcaagcagagaatgccctgctttctgtttttcttcccaaccaagtcggtaatgtttgcctaacattccttttgccaacgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggcaatactttgattgcggcttcttctaacacacaggcttcttcacacttaccacaccctgtacacgcatcggaatgtaccgttgggataaacattgcgtgtttacccgtacgatcgttgcgttgcatttcaagggtgatcgccttgtcaattaacgggcaaacccgataacacacatcacaacgtaaaccttgccagttcaaacaggtttcgtgatcaagcagaacggataaacccattcgagcatcatcaatattcgttaaatttggatctaacgcaccgcttgggcaagccttaacacaaggaatatcaggacacatttcgcacggtttatcacgagcgataaagtaaggtgttcctgcttccattggtgatagcaatgaagccaaatgcaacatatcgtaagggcaagcctgtacacattgtccacagcgaacacaagcggctgtgaaatctttatcatcggctaatgcacctggtggacgcagtgccacgccttgtcgagcaaggctttggttttgttgtaaggctaagatgatccccacaccacaaacaccgcctgccgtgcgtgtcgcattttttaaaaattggcgacgatttggatcgagtttcaatgcctgttccttatttgcaaattgttgctcaaatctaaccgcttacggggtatctgatattcttcccccatttatgggggaagtaccgcctcaggcggggatgggggatatcaactatgcccccatcggtttcgcttcgctcaaccacttcccccacaggtgggggaagtgttcttggctaagccttcacaaccttaaccgcacattttttgaagtcggtttcttttgagattgggtcggttgcatctaaggttaatttattggctaactgacctgcatcgaagaaagtggtgtaaattaagccttcaggcactttgttacgaccacgagtatctaaatgcgagatcatctcaccacggcgtgaaattactttcactttgtcgccgtgacgtaaacctcgtttttgagcgtccgttgggtgcatccacactaagttattcgggaatgaacggtgtaattcaggtacacgacgggtcattgagcctgagtgccagtgttcaagtacacgccctgttgataaccataaatcatattctgcatctggtgcttctgcaggtggttcatacggtacggctaaaatcactgcacgtttatctttattgccgtagaaagatacgccttccccagcttgaacatatgggtcatagccttcacggtaacgccataaggtttctttgccatccacgaccggccaacgtaaaccacgtgctttatgataagtttcaaagtctgctaaatcgtgaccgtgaccacgaccgaatgccgcatactcttcaaataaacctttttgtaaatagaagccaaaatgggttgactcatcattgatgtaatcagctttatccgttggtacttggaatttatccacttgaccattgcgatataacacgtcgtatagtgttttacctttatattcagggtttgctgctaatacttctgctggccacatttcatctgtggtgaagtatttagagaactccactaattgccataagtctgatttcgcttcgcctggtgctttcacttgttggaaccagaattgagtacgacgctctgcgttaccataagccccttctttttctacccacattgctgttggaagaattaaatctgcagaaagtgctgaaactgttgggtatggatctgacacaacaataaagttgcgttcgtcacgccagcctggcatacgctcttggttaatattcggaccacattgcatattattgttacacattacccagtaagcattgagtttaccgtcttttaatgcacggtcttgtgccacagcgtgcaagcctactttagtttggataacaccatttggtaacttccataatttttctgcggttttaacgtgttcagggttagtcaccactaaatctgctggtaagcggtgaataaaggttcctacttcacgtgctgtaccacaggctgatggctgacctgttaatgagaaaggtccacaacctggtttagaaattttgcctgtcagtaagtgaatgttatagatgagatggtttgcccacacaccacgaacgtgttggttaaagcccattgtccagaatgaaacgatgttcaggtttggatccgcatacattttcgcaaggctttctaactgatcttttggcacgcccgataattcgtgtgctttatctaaggtatattcagaaacaagctgtttaaactcttcaaagctactgtcgtgcattttgcctgcagtttttgcatttttagccgcttgttctaatgggtggttgtcacgcagaccgtaaccgatgtcggtttcaccacgtttgaatttggtgtgtttttggataaagtcttggtcaatcgcattgttttgaattaagtaatttgcgatatagttcataatcgctaaatcaccttgtggtttaaatacgataggcaagtccgcaagttcaaaagaacggtgttcaaaggtagaaagtaccgccacttttgcatcttgtttagataaacgacggtcagaaatacgcgaccataagatcgggtgcatttccgccatatttgatccccaaagcacaaatgcatcggctttttcaatatcatcatagcaacccatcggttcgtccataccaaaggtacgcataaacgcaaccgctgctgaagccatacagtgacgtgcatttggatcgatattatttgaacgcaagcctgctttaaacagtttagattttgctaccccttcaaagatcgttgattgacctgaagtgaacatacccacgccatttggcccttgctctttaatcgctttcttgaatttttccgccataatggtgaatgcttgatcccaagaaacaggggtaaattcaccatttttgtcgtatttaccgtctttcatacgcaacattggcgatgttaagcggtcttttccgtagataattttcggcaggaagtaacctttaatacagttcaaaccacggtttacttcggcatcagggtcaccttgagaagcaaccacacgtccattttgcgtacccacaagtacgctacaacccgtaccgcagaaacggcaaggtgctttatcccatttaatgctattgtcgttagcgtacacatttttcacaggtaacgtaatacctgcggcgagagctgctgctgccgctgcatttgctttcataaaatcgcgacgattgagttccataaattccccacaaaataataggtaataccaaattaaagtgtttcatcttggtggctataaatcagcgacaccacgataaccccttcaatatctttaatcatctccatacgatcaaccaaatcaggttgataactggactccaaaacaaccacgagcttactctcttcaagtttcaccccgtggatttccgtattcggtaactcagttaaggcttgcttcaccaagtccaacttttcaggtttcacttgaaccacaaggctacaaacataccagttgtctgcttcatcgtagttcaacttatcagatacatttctcatttcattcacttaacgggcttgcaacatttctcaccaaagtgaccgcttgtgtcggacaaactgccatacaagccccacaaccattacaactttccacatttaattcaggcattgccactcgccccacttgtcgcttaaagcgaatagcgcggctttcacaactatcttcacaactacggcattccacaccgctaaacatcatacagctttgctgaatttcaacataatgaaaccacgctcgctcatctgttgaacgaaacacatcggcttcacacgccttcacacacgcctgacaaaaagtacactccccacgaccattcataaaattgacttcaggataaccaccagcccctttcactaaaatttgcgtttcacacacagcaatacacttatcgcaagcggtgcatttatcaaaaaaatttgcaagatcagtccaaggcgctcgaacggcttgatgcccttgctgagccactttttcgtcctgaagtgatttcaaaaaatgtccacgcaaaaagctacggcgaggtaaagtcgtttctgtaaaattagccaaaaatagtttactcaatggataggttattgatgttaatgattgtaacatttataaaacataaaaaatgcaaacaaaatacattttatgaatgttatttgacaataatcaataaaaaagcggtaaaaatgatttcattctcaccgctatatattttattttataatgatttttcttaacgctgtcttgccttaaagcgagggttcgttttacaaatcacatataatttacccttacgacgaaccacttggcaatctgggtggcgtgatttcgctgatttaagcgaatttaaaattttcattttgttcccttttattccttattttttcgttaagctcgaaatgcctttaaagcgttcattaaatttgcttgcacgtccttcagtattcgcttcacgacgtttacccgtataaacagggtgagaagcagaagaagtatctaatggataaagcggatactctttgccatcttcccataccattgttttattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgccgcacaagagcggataatccagccttgttgcacactaccgtcgtaaaataacacttcacgataattttcagggtgaatcccttttttcatatattctcctagtcaaaaactcagacttaaaaccataaattaaatacgggattattttgcctgaaacaaaataaaaaagctataatttttttatggtctttgttaattttttcaacttaaacgaaaggaaataacgaaattgcgaactggatctaagtttcttcgcgataaatatgctaggctattgctattttgtaagtaggagatcagacaatggcaaaacaaccttatctaatcgctccgtctattttatctgcggatcttgctcgtttaggcgatgatgtggcagaagtattaaaagcaggggcggatttaattcattttgatgtaatggacaaccactatgtgccgaatttaaccttcggacctgcaatttgtaaagccctacgggattacggcattacttgcctgattgatgtacatttaatggcaaaacctgttgatcgcttaatccctgattttgcaaaagcaggggcagacatcatcactttccacccagaagcaacagagcatattgaccgttcattacaacttatccgtgaacacggctgtaaatcaggcttagtatttaatcctgcaacaccattaagctacttggactatgtgatggataaagtcgatgtgatcttattgatgtcggtaaatccaggttttggcggacaagcattcttgccatctactttgaacaaattgcgtgaagctcgtcgtcgaattgatgcgagtggatttaacattcgcttggaagtcgatggcggtgtgaaagtcaataacattgctgaaattgcagaagcaggggcagatatgttcgttgcaggctctgcgattttcgatcaaccagattataaagctgtgattgatcagatgagagcggagttggctgtaaaataatactgtaaaatatctaagaggttaaccagattaaaactatttattatatctatcaggttaaccccttaatgcccttaaatttcatcaataatccgatacacccaattctcaagcgggtcgttcagacgtttcatttccaaacgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatctcttcgagcatctcttttttgattgctttgtaagcgtcatcatagaagagattgtgcatttcctcaggatctttacggacatcatagagttcgcagaggtcggtggcgttgaataccaatttgtagtctttacgtcgccacatacgctgttcaaagtaaacaaagtgtcctgcaagttggcagagcaagcctttgcggtcgttctctttgttttctctggtgatcggtaaaatggtttccccttggaactctggcggtacttcttgcccagccacatcatagaccgttgaggtgaggtcgtgaagatagacgagattgtcatcaacttcattgatacggttagattgtgggtctttgatgatcagtgggacgttgtaggtggtttcaaacataaactcacctttttcaatcatacgatgtgcacccattgcatcaccgtgatccgccgtggcaacgaggaaggtgttttcatataagccgttttcttccaagaaggtaaacagctcaccgatagcgtcatcaattaaggtgatgtaaccccagaatttggtgatcacttctttccaacgctcttcgctggcttcccacattccccacatttttgagatggtgcggaaatgccctggtttgccttcaagcggtttgaagaaactttcatctagcacaacgtcttttggatcgtacattgagtagtaaggctcaggcacgatacaaggggtatgtggcccccagaagttgatccaagtgaagaacggtttaccttcagccagcgactcgcggatatattttttcgcttcgtcaatgatgaagtattcaatggtttcttcttttgtaccagaaagtaaaccgcacaattcttgtacgcgtaaatgagggttatcgccaaagtaagctcggctgacttcagggatttcatagcctttttcttctagccattcacgataacggttagagtgtgtcggcggttggttgaacactagatttttatagacttggctacctgggtaaccgtagccatcaaaattgtgtcctttaatcccgtaatcttcaggaacagattttgtgccgacgtgccattttcctacgacataagagttgtatccttctaaattacagatgtttggtgcttgttggctgatttcccctgtgccacctttttcaccgtttttaataatcccgtgactagaaggcattaaaccggtaaacaatgatgttcgagcaggtccgcaaacagaggcaggcgtaaacgcattattgaaacgaataccgtctgctgcaagtctgtcaaggttaggggttttgacaatttggtgtccgtaaggaccaagcatatctttgcggacttggtctaaaagaatgtaaacgatgttgttcataacgctattccattattttagggtagggacacactgcgtgtgtccgtacatttgtctttctttggacacacgcagtgtgcccctacactttaattatgctttttaattacgctttatctaccactttctttttaccgaagaaaatcaagataagcacttgcaccacagcccatacgcccataatcattgtcgcattaccttctgcggaagctaaaccaagtggtgataacaccaagtgtaaggtaattaagcctaacactaatgaagccacagctgttcttgcatattcccagtgggttaagtccacgtttgaatggttgatttggttatcttcgtatggggtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtcgcacgttttaagaattgacctaagataagcattaacgccacatcaaagacaaagagtgaacccattacatacacgaaattcactttgacattaatcacccacactaaagtgaagtaaagtacaacgtgagctaatagggtaatacgagccgctaaacctgatacatagcggttgaacaatccaacggcaaagagtgccacgataggaatgttaaagaagcctgcaaaacggcgagtaaacaagaagataccgtctgtaccgaacattaataacggtgcaacaatcattgtgatgatcgccattacggtaccgatttttttcgcataggcaataagttcttcatcgctgcgttttactttggtaatcgcaggtaataagtcgttacagtagatggttgcggctgaatttaagaatgagttgaaggtacttaaaatcgctccgaataatgcagccacaaagaatccttgtaaccaagtcggtaacactttattgactaaacttgggtatgaggcatcaatcggttttaagccttcgccaagaatgtgatagctcaataaacccggtaagttaaggattaacggtagcaacaagaggaaaagtgctgcaattaaaatccctttttgacccgcttttaaatctcttgcccctaacgcacgttgtactatcgcttggtttgttgtccagtagaagaagttgacgattaagatacccgtgaagatagctggccaaggcacagcgtctgtggcactaccgatagcattgaatttttcaacgtgggttgtgctgataatgtgtaaaccttctgaaatgctaccgttacctaaataagcaagggcaaagataggcacaagtaaagcaccgatcactaagatcaccgcattccaagtatccgatacggcaacggctttcaaaccaccgaaaatcgcgtaaattgcaccgatgataccgattgcaattacggtgtaagtaatcgcttcgccatagctgagattaaacacttcttgtaggctgaagattttattaaatgcaatcgcccctgtataaagtgcggttggaatagcaatgaaaagatagaagaacaagaagagcgtggacataatcaaacgagtttgtctgtcaaaacgtgcttcaaagaactctggaatagtggtgtaaccgttacggatatattttggtaacagatataatgcaaggaaacagagtgggataacagattgtaccgtccacgccataatcgagaagttacctgcataagagtttgcattgatcccgattaactgttccgttgaaagtgaggttaataccattgagcagccgatgactgcaccactcaatccacgccctgcaaggaaataaccttttgaggtgcttaaatcatcatctttggttttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagagattaaaccgactgcagcggttacgatgataaaactgactatcgtaagaaacatatagtcctccttagtttcagataaagtttatgaagttgctattctagaaatttagaacagctttagcataatctcgttagatgtaaataaattatgataattgtcataactgtaaagtgatcttgctcacaaatttagaaaataatgaaatttcactcggaaaaatatgaggacgatcataatgggatagcagatttcactttcataatagaagctgtaggactttcaacacctctatattagggggaatttatgacaataaccacaattttgattttaatcgcctgtggcatactgactaatttaatgtcagcactgtttgggatcggcggcggtgtgctaatggtgccgattttacacacgctgtttcctgaattttcgttacaaatggttgcggcgacctctttaatgacagtaatgggaacagcggcaatcaatttagtctatttctataaacagcgtgttcctgtcaaaatgaaatctctgttgctgtggtcaattggaatgattatcggcgttcagcttgggtttgaaatcagttttttcattccaaattgggcaattgttgcagtgtttgtgactacacttgttgtccttgcattatgtcttattctcgcaaaaaaatctgagaattccaccgcttgtagctcgttaaaagagaacattaagggaatttcagtgtgcttatttggtggaagtgtcgcaggaattacaggtattggcggtggctcaattatggcacctcttattagtttgttaccaagcgtcaaaccacatcaaatcgccgcttatagcaactatatgatgattattggtggattaggaaacttatacggttatctaagcaaaattccaccagtctatttagaaaactcttggcaagtgggatatgtgaattttaccgttgtgtctattgtggtgctatgttcatttttaaccagtttcttttcaatgaagctgagagggattttaaaaccgcttacaatgcaaaggttgctaagtggtattttgttgatgattgctggttatatgttgatcttgcagggtgttcgttattaggctggtaaatattatttagatagcgtaatttgatgttatgctctatggtatatttaaaacattaatattttgtcatcaaatatggcataatttaattattgatttaatggggactagtattatatgaatatccgagatctagaatatctaatcgctttagctgattttaaacattttcgtaaagcagctgatgcttgtaatgtaagccagcccacactgagtgggcagattcgtaagttagaagatgagctcggaactgtgctattggaaagaactagccggaaagtactctttacccaatcagggcttaccttagttgaacaagcaaaagctgtgttaagagaagtgaagattcttagagaaatggcaagcaaccaaggtaaagcaatgtctggccccttacatattggtatcattccaacattaggaccttatatttcaccgataatttttcctcaactaaaacaacttttccctagattagagctttatatttatgaactacaaacatcattacttgtggaacaacttgagtcgggacaactagattgcgttattttagcttttgacaaagaaagcgcaccatttatcgaaatacctatttttaatgaaaaaatgctacttgcagtatccaatcagcataaatgggcaacaacaacctcaatagacttatcaaaattacgcgatcaagaaatgttgatgctagatggagggcattgtctacgaacacagttgatggactattgcttatcaatcggagcaaaagagaacagccactttaaagcaaatagtttagaaacattacgtaatatggttgccgcagatgaaggaattgcgtttatccctgaactagcagctaaaattggaaaaacagataatttacactatattcattttaataatcctgaaccatatagaacaattgggttaatctatcgccctggctccccattacggttgcgatatgaacgccttgcaaaagagattcaaaaaataatgtcagagattcaataatgagtagtggaatcagagcaatccaaaaagagaaaactcgccgtgcattagttgatgctgcatttaaccagctaactgcagacaaaagtttttcaaatttaagtctacgtgaagttgcccgtgaagcgggcattgcaccaacgtctttttaccgacactttaaagatatggatgaattggggttagcaatggtagacgaatcagggttaatcttacgtcaattaatgcgccaagctagaaaaagattagaaaaaggggggagtgttattgctatctctgtagaaaccttttttgaacttattgaataccgccctaatatgtttcgtcttttgctgagagaacgatcaggaacctcgcaagaatttagaactgccacgtcacgtgaaatccagcattttgtagcagaactcgcagaatatattcaacaaagagatcacgcaataactcaggaactagcttatattcaatctgaaggacttgttactctcgttttcacagcaggttcccatgctttagacttaaatagtcaagaacgagaaaaattaaaacaacgtgtaattacacaattaagaatgctagctagaggagctgcagcttatactggtggtaagaaataaaatgaaaaagcatggcattatcaactgttctatgaaaaatattttgttatttgtgagtttatttgtattgatcaacactgcagcagattggtttcgtagacccaatccctctcatcaatttgcagaacaagttttatatgatttggagaaaaatcctcaaattattgcacaactaagccaccaaaaatcactgttactctatttttggggcagttggtgcaaattttgtgaatatacctccccatccatttctcagcttgtactagatggcgccaatgttttaagtattgctctcaaatcgggaagtgatgatgaagtaaaacagtatatgaaaactcatcaatatcattttgtgactatcaatgatccaatagggacattttcaaaaagttgggatattcaagcgactccgacattaattattgtaaaagatggcaaaatgattagccacactactggcttctcaacctattgggggattaaaattcggttatggttagccgattgggtgagataaaaacaagcggtcagattgaacgcttgttttgcaaatacactctattttttcactaaaaataaaatcgcatcaatataacgttgaacaaattcgttggttgagcctgaatcggagaaaccttctggatttagctgatattgttcattcacaaaaaatgctggcacgccacgcactttaaattcttcagcagcttgagtttgttttgtcactaaaccattcaccgcaaagctattaatgccgccgtcaaattgttctgcggtaatgccatttgctaagaaaatcgcacgaatgtcgtccattgatttaattgcatctttttgtgccgcttcaaataatgaggttttcaccttatcttccgcgcctaatgccattgctaatgcccacgctcgtgttaattctgtcgattgacgacctaaaaaatcaacgtggtactgttttaacactgccccttcaggtaaacctgctttgactttacttggaattttgtaattcaattcaaaatcatagcagtgtgggcaatagaaagagaaaaattctaacacctctttttgagccgaaggcacttggcgaacttcgagatactctttatttgcaacaggatcttgtgccattgcggttgttgaaaaagcccctaatgcagaaagggcaatgaatacggtttttaaagcaaatttcttcataaattcctcgagttaaaaaagtcgatcctatgacaacattaatcatttaaaattccacgcgcttttaataaagcggttttaaaatcttcttcgtaatcttttttgataccagggatcacttcggttttatctttttcactcattttgagttgataaattaacacttcatcacgcagtgcatctaaatcattcggtttgccaacttcttcagcaagtttgtgtaataaatcaagtaagtgaagatcgggttctttacgccaatgttcacctaatagctctaacacttcgtctaaacgtttacatttcatcagaaaatccttaaaaaatttggaaaaaactaggcaggatcatatacttttaaggttaattttgcaaaaacaaggggaaaataaatgcaatttaatcaaattcaaggggtaattttagcgggggggcttgctcgtcgtttgaatggggtacaaaaaggattgcaacttctacaaggtaaacctctgatttctcatattttggaaagattatccccacaaatttgcaaaatctggttgaatgtgaaccgcttgcaagcgcagtatcagcaacactatcctgatattccgctttatgccgattgtcttgaaggctttcaaggggcattaagcggtatgttatcgggctttgaacaaatcgacagcgaatatttgctgtttgtcccttgcgacagcccatttttgcctgaaaatcttgccgtaaaactaagtacagccttacagatcaacaatgctcaaattgcctttgcccacgacggtgaacgcccacacccgacttttgccttaatccaccgttctgtattacctgcattgcaagattatctgcataatggcgaacgtcgtctatttcagtttttccaaagccaacgcagtattgccgttgatttttccgaacaaaaacaggcgtttaaaaattttaatacaccagaagattttcttccttattctctccctccgcttgcggagggagatgtccgtaggacagaggggggcattccgttgcttgcagtgacaggctatagtggcacaggcaaaaccactttacttgaaaagctcattccccagttaaatcaaaaagggataaaagtaggtttaattaagcactctcatcataatgtcgatgtcgataaagcaggaaaagacagccaccgcctacgtttagcaggggcaaatccgacaatgattgtgtgtgaacagcgttgggcgatgatggtggaaacgaatactctcgcgtcttttaatgtactggtaaaacagatggaaacacaaaatgtcgatctgattttagtcgaaggcttcaaacacgaaaccttgccgaaaattcagctacaccgaaaagagatggataaacccttacctgagttagatctcttcacccttgccaccgcaacggattatccgttggaaagagaaaatctgttggatattaataatgtggagcagattgcggagtttgtggtgggtgttttggaagggtaacgtattggagctaataaacgacatagtaggaaaatttatgtagcaactgctacataatatcgatagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattccttataaatatcgtaatgtaagaagtacttatatcagtttaaagcattatatagattttatttttacctatgagaaatattctgaattaaatatagaaaagactatagatcacttagagggattatttagaaaacttgagtggaaatcaaataatcacaaggggttaacgaaatatataacacgttgtttataaatgattttttaaataaaaaagttgctaatatttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattagcaactatttcgtctactatgccagatatctatattagcatataaccataaataatagtttactgcttatagtaaatcacttccttagccaccaatctatactttatattctaaattactttagattagacatagtaagtcattggtaagattaaatttccttccaccctaactcctgcgaaatagcttgtgcagtttgttgtacctcgcgtataaaatcccccatcgtatattcattcaaacgatgaatagaagttgaaactgaaatggcatattccactctgccaaggtgattaaatacaggtacagcgaggcagcgcacgccaagttcattttcttccctatccattgcaaaaccagatttaagaatatcgttgagttcttgacgcatagcttgaatgtccgtaatggttttgcaagttctctgctcaatctgaccgctatgtgcctgccaataacgatctaaatattctttattttcttcataagcaagataaagtttacccattgcagaacaataaagtggcaaatgttgtccaatataggcgcgcgttttcatcatacccattgttggctcgagcttgtaaatcataatcgcgtgatcgtcttctcgctttgaaaaattgacggtttcacctaaggcaagatttaatcgttctaaatgcggggaagctaaatgaataatattcattgaagcaagggttttctgccctaaacttagacattttgttgttaaacgatagctaccaacagaacttgctgctttcacatacccctcgttttgtaacccttgcagtaaacggtgtacggtacttttgttaagttctgaaatttcagccaatttcgctagtgggcaaccatttggaaagttacttaaaatatccattaaacgtaaaccacgaataaggctttgatttccaccacttttttcctctgccattctgttctcctatttcattttatacctcctatcatagcatatttttctgtttcatattttggaatgcaatcccataaaaatgagatcttgctcacaaaactaaaaatttacaaataacatattgattttaaatggtttttatttttatggtttgattgacttttaatctgtttaggtttaatttatgaaatatcattttgatatatgaaacaaaggggttactaatgaaagtatcatatcaagagcttaaagccgaatttaaacgtgtgctacttgcccgcaatgttcgtgaagagattgcagaagagtgtgccacaatgtttgctgacactacccaagcgggtgtttattctcacggtgtaaaccgttttcctcgttttattcaacagttagaaaagggcgatgttattcctgatgcagtgccaaccaaagtgctttcgttaggggcaattgaacaatgggacgcacatcaagccatcggtaacttaactgctaaaaaacagcgaaatcggtcaaggtttattaaaagatttagaagcacaaggattaaaaggcttagctttctgggaagtcgggttccgctcatttactaactcaaaacacccagttaaatcacctgaagacatcaaagggttaaaagtccgtactaaccaaaacccaatgtatattcaggcatttagcctacttggtgcaaatcctgtgccaatgccactttctgaactttatactgcgcttgaaacacgagcagtagatgcacaagaacacccaatcggtattttctggtcagctaaactttacgaagtacaaaaacatttaagtttaaccaatcacggttatactccattaattgttgtaatgaacaaagcgaaattcaacagtttctcaccagaattacaacaagcaattcttgatgcagctaaagaagcaggcaactatcaacgccaacttaatttagagaatgaaaaagagatcatcgctaaattacaaaaagcaggtattcaagtgattgaagaagtagataacaaaccgtttaaagccatcattgaagcagatgttcgcaaagcctttattgagaaaaacggcagtgaattagttgaaaaaattgatgggttagcgaaataatacaccttctctatccccctttttcccaaaagggggatttgctaatacagaaataaaaaggaactcaaatgaactactacttaggcattgattgtggtggcacttttattaaagcagcactgtttgatcgtcacggacaaatctgcggacttgctcgtgaaaatgtagcggtcatcagcgaaaaagcaggttatgcagaaagggatatggctcaactttggcaagtctgtgccaatgttattcaccaaacacttgaaaaaagtgatgtagagccaaccgcaatcaaaggagtaggcatttcagctcaaggaaaaggtgcgtttttactggataaaaataaacaaccactaggtagagcgatcttatcttccgaccaacgttctatcgacatcgttaaacagtggcaaaaagaaggcataccagaaaaactctacccaatcacccgccaaaccttatggacagggcaccctgtttccattttacgctggataaaagaacacgaaccagaacgttatgcacaaatcggttctgtattaatgtcacacgactacttacgcttttgccttactggtgaattacattgtgaagaaaccaatatttctgagtccaatctctacaatatggcagaaggaaaatacgatctccaacttgctgaaatacttggtttgcaagaaatcattgataaattgccgcttgtgatcgccccaaaccaagtggcaggttatgtgaccgaaaaggcttccgctctttgtggtttagcggtgggaacacctgtggtcggtggcttattcgatgtcgtctctaccgcattatgtgcagggttagatgatgaaaccaaacttaatgccgtactcggtacttggtcggttgtcagtggtatcacagaccatatcgatccaaaccaagatttaccgtttgtttacggacgttatgcacaagcgggcaaatttatcgttcacgaagccagcccgacttcagcgggtaatttagaatggtttatcaaacagtggaatttagattacgctcacattaatcaaacgattgccgaactcgcgcctgccgctagctctgtactgtttgtcccattcctttatggctctaacgcaggtttaggtatgcaagcaggtttttatggaatacaagcatatcatacacaagctcatctactccaagccatttacgaaggcgtactgttcagcttaatgcatcatctcaaccgaatgctacaacgcttcccgaatactcagatactccgtgttacaggtggaccaacgaagtcgccaatttggttacaaatgctggcggatttaacaggagtgatcttagaagtaccaaatattgaagaaacaggttgcttaggggcagcgatgatggcaatggaagcggctgacgaaaatcgcccagaactattgcaacaagcaatgcgtcaagtgcaaccaaatcctgaacattttgaagcctatcaacaaaaatatcagcgttatcaacagttagttactacactgaaagcattacactagataagttcaagcggtaagatttattgcaaatttagcaactgctcttaccgcttgtacatttccaatcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggctcctacaaaacaggcaattttgcactctccacaaccgttgtataccgatacaaacagatgttcggggcaagaaaacggcgggcgggcaacttggcgagcgatttccgtactcacacttttttgcgtaccgccaagcaaactgcgaaatagccctctgcacgaaagggggcagtttttgtatcgggattccatcaacctctacccaatttgcctgaattaaccacgttctctaatgtttatgcagtttcacctgactgccagccgtttaaatcttatgttgtcgcttcgcttgatgatactgttgtgccacatcaatatagtgatgatttagccaaacatttaaaagcagactatatccgtttgccaactggggggcattttttagatcgggaaggttggaataaatttgagcttatacttgaattaatttgtaaattaaaaggatatacagagaagaattagaaaaataagacatttatttaacatctaactttggcatagtagacaaaatgccatgcctgtctactatgccgcctatttggctaaaaatagcgataggcttcctttacttattgcaataatatttattaagtattttgcttctctacctgattaaattcaagttcaacaggcgttgctcggccaaaaatggaaacggacactttgacacgacctttttcataatccacctcttccacagtgcctgtaaaatctgaaaaaggaccttctttaacacgaacttcttcacctgggtggaactctgttctgtgacgtggtttatccgccgtttcttgaacacggttaaggatacgctctgcttcactctgagaaattggtgcaggcttatccgcagtacctccgataaagcccattacacgcggcacgctttttaccagatgccacgtatcatcattcatttccatttgaactaacacataacctgggaaaaatttgcgttctgttttacgacggcgtccaccaacattctcaaccacctcttctgtgggaacgagcacttcaccaaattggtcttgcatattatgcaatttaatatactcacgaagagtcattgcaacacgggcttcaaagcccgaaaatgcttgtaatacaaaccaacgcattttgcttgtatctttttcttgttcgactatttcaatctcgctcatattagaatctcaaatttgttaggaaatcaataattaacacaataatagagtcgataccccataatgctaatgccactaccacgcacattgcgacaaccattaaagttgtttgcgtcgtttcttggcgatttggccaaataattttacgtaattcttggcgcgaatctttgataaaaccaattgattgctgaccttggttagtcattgcagcaacacccaatgcagcaacacatagcacaactaacagcaatatacgaacaattaatgaaaagtattctgcaaaataggtatttccaatagctgctattgttaataatgaaattgaaaatacccataatacattatttatacctttacttttgacacccttttctactttatccagggttatgttttgaatttctttagccatagacaacctaaaatttattacaaaagtgaatattcaattataaagcgtgcaattctagcattttctgctggtgttgccacgatcttttcacaaatttcttgtgaatcttattatttttttgagtgttacaaggattttcaagtacgttattactttgcactataaccttgtcatctatttttagaatcattctaaaaaaataccataaattcaatctgtgataatttcaactagtaagcaaaaataaagcacatctaaccccttccccccacggtaatcttatccaacttcaccgtaggttgcccaacgccaacaggtacagattgcccttctttaccacaagtgcctatacctaaatccagttccatttttttgccaaccattgacacctgttgcattgcttcgataccgctgccgattaaggtggctcctgtgactggtttggtgattttgcctttttcgattaaataggcttcggacgttgagaatacgaatttgcctgaggtaatgtccacttgtccgccgctgaaatggggagcgtataaaccaaagtccacggattcaatcatttcgtcgaactcgtgattgccttctgtcatataggtgttggtcatacggggcattggtaagtgggcataagactcacggcgaccgttacctgttggggcaacgcccattaaacgagcattgagcttatcttgcatatagccttttaaaatcccgttttcaatcaatacattacgttgtgaaggcacaccttcatcatcaacggtaatcgaacctcgcatatttggcacagtaccgtcatcgacaatggtacaaagtggtgatgtcacaagttcgccgattctgtttgtgaacattgatgattctttgcggttaaaatcgccttctaaaccgtgtccgaccgcttcgtgcagtaagatcccaggccagccagccccaagcacaatcggcattgagccagcaggtgcagcgactgcacctaaattcacaaccgcttgtcgtacggcttctttagcaagatagacggcacgactgtcgcctgtatagtgtggtgctaagaaccattccaagccaaagcgtccaccagcccctgcactgcctcgctcacgtttaccgttctgttctactaataccgaaatagataaacgcactaacgggcgaatatccgctgctaaagtgctgtccgttgcagacactaacatttcttcatatacggcggacagatttgcgttcacttgaattacacgaggatcttcggctctcaccactttatcgactaagtgtagtagttcaactttctgttcacgacttaaggtatcaaggggattgatcgaggcatagcgtttgatagcggtcgtttctttgaaaggttttaccaataaccgaccgctttcttgcgtaatactacgagcagccattgcacattgctcaagctggctgagcgagatttgatcggcataagcaaagcccgttttttcccctgacaccgcacgcacgccgacaccacggtcgatataaaaaccgccttctttgataatgctatcttctaacgaccaactctcatcttggctaaattgaaaatagagatcagcatagtcgatttgacggccagaaaaatgatccaacactttcgtcagatcggataattgaagtccgctaggtaacagcaaactgtttgaaacttggtttaacattggttttctctaaataataacaagcggttagattttaacggatttttgcaaatgatagggaaatttttaggggaaagatgatttgtgatatacttcgcccgattatctgttttatccaagaagttttacaatgctagatcctcttcaatattatttccttgaaatgcgagagcattatctaaatgtaccttatctcaaccaacaacgccgaatccgtgtgcttttacccaaagggtatcgtgaagaagcagggcattatcctgtgttatatatgcacgacggacaaaatattttttatagcaaagagtcttattcgggacattcttggaaagtgattccgacgattaaaaatcacaaagaatttccaaagatgatcattattggtattgacaatgcaggccctgatcgtcttgatgaatatggtccgtggcgaacagacacaggctctacccctgaaacccaaaatgctggaggatatggaatggcgtacgggcgttgggtggttgaaacggttaagcctttcatcgatcaacattaccgaactaaacgtgatcgtgatcataccctacttgcaggtagctcaatgggcggtattatcactgcttatatgggagcggaatatcctgaagtattcgggcatttaggcgtattttctcttgcctcgtggtttagtgaacctgcctttatggaatttattcatacacacccactcaaccgctcaagcaaagtgtttattcaagtgggaacgaatgaaggcgatgaagtggattcacattttatttcaaatatgaatcaggcttatattgactgtacgctgcattattaccaagcactaatccgcacgggacatcctctcgataatattcgtctaaaaattatggcaaatgaaatccaccacgaaatgcactgggcggatcattttgtcgagtttttacggttttcattgatgaatcattaaaaagttattggaataaatacccaatacttctatacatcatttcagattatctatatacgctataaagtataaaaatcatagttatactttacagcgtatatttcataaattatacttcacttagtataaaataaatttggaagaaatatgttaatcacgacaccagatatgcttggaaatagcctacgcgatattcgtaagcaaaaaaagctttctcaaatgcaaatagcaaatcaagtagctttaagacaagccacgatttccacctttgagaaaaaaaccgataaagccactattgaaacattatttaagttactttcaggtttaggctatgaactacatatccaccctcgtcctgaaaaaacagaggggaatgatgaatggtaatgcgattacgagtattaatgaatggcgaaatggttgggtattttgaccgcactttatcgggttcccaccatttttcctatgctgaaagttggctaaattccccattagctcgcccgatttccctttctatgcccctgcaaagagcaacatatcaaggcaaagaagtgattaatttctttgataatttactgcccgataatcctcaaattcgagcaagaattgcgacaagatttaatgctgaaacacaacaaccttttgacttacttgctaaaattggtcgcgatgctgcgggtgctattactcttttaggggaagatgaacaaattcctaatcatcgaataattcaagccacagaattagacgaaagtgaaatgacgaaaattctacaaagttatcaatacaatgccccacttggtatgattgataataatcaggacttcagaatttctattgctggtgcacaagaaaagacagctctgctttggcataacggcaaatggaaattaccacacggattgaccccgacaacgcatattttcaaattgcctatgggagaaattcgtacccctaaacacctgcttgatctgtcaaaaagtgtagataacgaactcgtctgtttgagattattttctgctttcaatatcccttccgcaaacgttgaattattggaaatgaacgatatacgggcattagctgttgaacgttttgatcgccgtcttagtcaagatggcagttattttttacgtttaccttacgaagatttctgtcaggcattcggcttatcgccaacgcaaaaatatgaaagcgatggtggaattggtattggggatatgatgaataagttgctctactccagtaattccaacgatcgccgtcaatttatgcaaactcaatttctgttttggctactggctgccattgatggacacgctaaaaacttttctctcgccattgaaaaacaagggcgttatcacttatccccagtgtatgacgtactttctgcttatccaatgttaggcggaaaaggttggcatcacagtgaattacaaatggcaatgagcttgcgtagcacgcaaaaagggaaaaaatggcattggagtaaaatttatgctgaacatttctatgccacagctaagtttgtcggatttagctcaagtgatatgaaacaagtgatagagcaaatttgcgatacagtgcaagaaaccattgatagcgtagcaacaacactacccaaacagatagatgaaaatgtacgggatcaaatattcacgggcataatgaaacaggtgcaaaaagtttctatgaagtaaccgctattttgctaacaccctcaccaaaacccctaacgcctgttcgatctcttggttccaagcataagaacaattaaccctaatccctttatgctgcgaagtaggcaaggtaaaaagctcacttgggctaatgctgattttttcttcgagcaactcttgataaatctgcatactatccaaatgttcgggcaggtgtatccaaaggaaatagccgctgctgtggtgttcgataggacaacttgcaggcaagtgctgacgtaggtaatctaaacactgctttttgtttttttctaaatgacggcgaaggtgtcgcagatgtttctcgtagtggtgattagagataaattctaccaaggcttgttgaattaaagcgttagcagaaatggtactcatcagttgcaaatgttggattttatcggcaaattgccctgcgtgaacccagcagatacggaagtttgcccctaaaattttagaaaaagaagaacaatgcaacacccagttttgtgcatcaaacgccttcatcggcaagggcttttcaccccgataataaagctcttgatacacatcgtcttcaattaaatgcacttgatattgagctaacaattccccaatccgctgtttgatttcggggctgacggtaaaccccagaggattatggcagttcagcataaaccaataaaccttgatcggataacgctgtaaggcttgctcaaacgctacaaggtcaaaaccgcttgggtggtcgggcgaagtaacaacatttaaacctaacttttccgcaatctgccacaccccataaaataccgtctgctgtaataaaatataatcgccctgttgcgttaaggcttgtagcgaaaggttcagtgcgtctaaacagctggacgtaatcacaatatcatcggcttgcgtaggaataccttgcaagcggtaacgttgtgcgattaatttacgcaattccacattgcccgacaacacaggctgtggctgatctcgcaaagacggcaatttctcgtgcggtttcaactcgcctgtttcaattaaatgtttaaggtgctgggtgagtttggtgtcagatcaagatgtttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggtcagccgtttagtctggcgtatttggaaaacgtattgcaagggcaaggcgagtttaattcggcaaacagcttactggctttaacagcggtgcaacaaattgctccagaacaagagcttgctgtgttgtcagcgttgcagatggcacgttatgtggacggtttggataatgcagattttgctgtggttgaacaggtgttgcacaagctcaaccttagccaagctgtgtcgttgcttagcaaacaatctacccaaacggcattagcacaacgtcttcaattcgggcaacaactcgcccaccattgcggtgtgcaaggtgtgccgcagttgattgtggaaaaagatgaacggttgcatattgtgccgagccagttgttgtatggtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgatgagcgttactaccgtaagctgaaagtgagtgattggctgagcaaagcggaggaatggaaggggataaaatcggtgttggaggtgtgtcgcaagcggtcagataatggcaaagaatcgcaagaaaaagtcttttatatcagtagtttggatgttgatattcaaatattggcgaagtgcgtgcgagggcattgggaagtggaaaacaaagcccattgggtgctagatgtggtctataaagaagacgaatgtgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcgtttaacgatgtcgcaacaagaacgctgggtttcaaataaagatgtgacgccagaacttaaacataaattggctgaatgtatttggtggcttgccgtgctttcaaaacgaatggatatagatttaaaacagtctatggaaacttttttatcaggtatggaacaacgtttggggaaataacaaaataacaagcggtgggattttgcatatttgagacaatcccaccgctttgtgttatcaagtcctcaccaacctactcaccacctgccctgctgttttttctttaattacctgccaatgttcaggcaagaccaacagcgagtgatttttttctgtttcgacataaatcaaggcgttttcagccagccagccgttttgttcgagtgccgttaagacttgcggtacaaagccttgatgaaatggcggatcgacaaaaaccagatcaaaaggcatttcgctatttttctgtgcaagaaattgtagggtatccgtttgaataactttgccattttcagcttttaggctgactaaattctttttgagttggtttgctgcgtctgcaaatttttctaagaatacaaccgcttgtgcttggcgtgagagtgcttcgatcccaagtgagccactgcctgcaaagcagtctaagcaacgagagccagcaatatccatcatcagccagttaaagagcgtttcttttactcggtcagtggttgggcgtaatccttcggcgtttaatacgggcagttttcgtcctcgccataaaccagcaatcacacggacttcgcctgttggtctgttttgtgtagaaattcgagtttttttcatacgaaatcgtaaaaattagggttaaaaatgatagactaatacaagtttattccatttttgtcgaaaatggattttttaattttaagagagagcaaaaaatgtcagatgaaaagaagaaaaaaggcttttggtcttggttaggtttcgggaaaaaagaagatgttgaacaaacgggaacgaccgaagaaaaagtagaagagaaagcagaagttcagccagaggaaatcaccgaacgagcggtcagttctaagcaatattttgcaaaagatgaagaagttatcgaagaaaatataacaaccgaaaacgtgactgaagtcccaactgaagttgtcgaagatgttatcgttgaacagacggcggaagaaacagttgaaactgtcgagcaagcggttgttgaacccaccgcagaaactacagaaaactcagatgaacaaacggaagagttgcaaatttctgagcaaaatccaccgcttgtagaagatgaaacgaaacaagatgtggaagatgaacctcaagcggaagaaagtgttcagacagatgaatatcaagaaaaaccaactagtgagggcggttttttcagccgtttaatcaaagggttaattaaaacgaaacagagtattggctctggtttccgtaacttctttagcggtaagaaaattgatgatgagctgtttgaagagttagaagaacagttattggtggcggatttaggtatgccgactaccacgaaaatcattaaaaatttaaccgaacacgccacaaaacagcaattacgcgatgctgagttgctctatcagcaattaaaagttgaactggctgatgtgttaaaacctgttgctcagccattggtattagaagataagaagccttatgtgatcttgatggtgggcgtaaatggggtcggcaaaacaaccactatcggtaaattagctcggaagttccaagcggaaggaaaatcggtgatgttggcagctggcgatactttccgtgcggcagccgttgaacagcttcaagtgtggggcgaacgcaataacattcctgtggttgcacaaagtacaggggctgactctgcgtcagtgatttttgatgcaatgcaatcggcagcagcaaaagggattgatgtgttaatcgcagacaccgcaggacgtttgcaaaacaaaaataacttaatggacgagttgaaaaaaatagtgcgagtaatgaaaaaatatgatgaaaccgcaccgcacgaaattatgcttacccttgatgctggtacaggacagaatgcgatcagccaagcgaaactgtttaatgaagcggttggtttaacggggattaccttaacaaaactggacggtactgcgaaaggtggggtaatttttgcgattgcggatcaatttaatattccaattcgctttattggggtgggtgaaaaaattgatgatttacgcccatttgatgccgaagaatttattgaagccttatttactcacgaggacgagaagtaatgatccgatttactaatgtcagcaaagcctataaaggcggtggacgaccagctctgcaagggattaacttccaccttgcagaaggggaaatgaaatatatcacggggcattcaggggcaggaaaaaccaccttgctgaagctgattatgggcattgaacgagccaatggcggacaagtgatgttcaacggacacgacattacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccttgcagaacgagaattgccgtttttacgtcgtcaaattggtatggttcaccaaaattatagcctactgagcgaccgctcgattttagataatgtagcattacctttgatcattatgggcgttaatcaaaccgttgcagaacgtgaagctcgccttgctcttgctcgtgttggcttggaaaataaagcgaacttccgaccgcttcatctgtcaggtggggagcaacaacgtgtagatattgctcgtgcgattgttcatcgtccgctgttattacttgctgatgaaccaacaggcaatttagacgacaaactctcttttgaaatttttcgtttatttgaagaatttaacaaagcaggcacaacagtattgattgccacccacgatacaaacattatagcccaacgccctaaaccgtgtttagagttggaagaaggacatttaaagtaaggatcgacaatgctaaattcacttaatgctcaaacccgttttattctgcgttcagtgtggcaagatctactcaaacgtaaatttggcactttcttaacggtattagttattacggtgtccttaacgataccgaccgtcagctacttgctatggaaaaatacgagccacgcagcggcggaattttatccagagccagaattgacggtctatctacataaaaacctagcagaacacgatattaatgcagttgttgaacggattcgtcagtttgataccgataaggtggactctcttaattacatttctcgccaacaaagcctagatgagtttcgttcttggtcaggatttggggaggcattagatattttagatgacaatccactaccagccgtggtgctcttaaagccgaaaaaaacctttacctcacctgaaaatatgctggaacttcgcaatggtttgcagaatattaaaggggtacaggaagtgcgtttggacaatggttggttagaaaaacttacagcgattacccaactcattgctcgtgtagcggttacttgtacggtgttgatgctgattgccgttttccttgttatcagtaacagcattcgttctgatgtgtctaatagcaaagcatctattgatgtgatgcaactattgggagcgacggatcattttatttcacgcccattcttatatattggaatgatttatggcttgctcggaagcctactagcgatgctatttagtttaatgactatcagctattttacaggggtagttcgttatgtatcagatatgtttacggtaaaatttgaactacacggctttgatgttagtgaggcgatttttattatggcactgagtatctttcttgggtggttatctgcgaagattgcgacgaataggtatattcagaagattggtggaaagtggtagaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaaattagcaaccattttgtctactatgcccttttttatagatagacgttagaaaccaatggttctaccatctggatttctcggatcagagtagccataaaatccatcttctctcgcttgaataatctgaattcttcccataggagctttaacattaattttatgtcctttttgctccaagagtttgagggtatcaggactaattccttcctcaatgcgtaactcatcaggtaaccattgatggtgtacgcgaggagttacaatcgcttcagctgggttcatcccatgatcaacggtgtttaaaatactttgtaacaccgtggtaatgatacgagcaccgccaaggctaccagtcactaaccatggtttatcctctttcagaactaaggttggtgtcatagaagaaagtgggcgttttttcccttcaacagcattaacgtctccgccaattaaaccaaaggcatttgcaacaccaggtttagctgagaagtcatccatttcattattcagaagaattcctgttccttcggcaacaataccactaccgaaattgagatttaacgtataagtgactgctacagcattaccttctttatccatcacggaataatgggtggtttgatcactctcgtaagattgtggttgtcctggtttgatatcagatgctgggcgtgctttttcttcatcaataccttggatgagtgattttgcatattctttagaggttaaccctttcgcaggaacttttacaaaatctggatcacctaaatattcagagcgatcggcataagccaatttcattgtttcagcgagatggtgaatcgttttggcgctattagaaccaaattcatttaatgggtagttttctaacatattgaggatttgtactaagtgaatcccacctgagcttggcagtggcattgtcacaattttgtatcctcgatattcaccagtaatcggtttacgttcgacggcttgataacctttcatgtcatctaaggtgatcaatccattatgtttctccatctcagcaacaatctttttcgcaatgtcgccttcatagaaggctttagatccctcttttgcgatttgacgtaatgagtttgccaaatctgtttgaactaaacgctcaccagctattaatggtctgccatctttgaaaaagatttttttactgctttcccatttacctaatgtttccgtttcttcttttaatgtacttgctaaggtgccacttaccacaaatccttcttcggcaagcttaattgatggctctagaatttttctagtggcagacttccccattttttcaatgcgtattccatgcctgcaacggttcctggaacacccacagcaaaatgggtgtaaagtgatttaccatctacaacattacctttgtcatctaggtacatatctcttgtagctttaatcggtgccatttcacgaaaatcgacagtgaagttttcgccactttttgcatcatgtagcaccataaaaccacctccgccaatatttcctgcgtttggtaatacaacagctaatgcaaaaccgaccgcaacagcagcatcaacggcatttccgccttgtttcaaaatatccacgccaatttgtgtagcgagttcttgctcagaggcaaccataccgtgttttgcataaacaggatggaaaatatctttgctactgtcataacgctgagcagcgatttgtgtcatagtaggttgtgtgtttgcaagtagctctgtggatagaggcaaggctaatgttgcagtcaaactgctaagtaagaaatattttgtcatggttttatgcatcatatatgccccttggtagtgactaattgaacaattttcattatgcataaataaaataaaaataaaacaaaaagctaacatttataacatttttgttaacagttagtgagacaagcggttactttcatgaaaaattttgcaaactgggcttaatagcgtgctatgatcattaagcttatatcagcatttattattaaggattcctatgaaactttattatctaccgggcgcttgctcatttgttccgcatactgcgttagaatggattggtaaaccgtacgaagcggaagcggtcaaccgtgacaaaatcaaatcgccagaatacttggcgttaaatccgcaaggtgcggtgccgcttttagtggatggtgatttcgcactatcacaaaacattgcgatcttaacttacctcgataaccttcatcctgaagcgaaactgtttggtagcgatacagcacaagacaaagccaaggcaatgcgttggttgtcattcttcaattcagatgttcataaagcctttactccgttttttcgtgtaccaccttatgcacaaggaaatgaagctttaacggtagaaattcgtcaaaatgcggcggacaatatgttaagaatgttagaaattgccaacgatcacttagagcaccacgcctttttcggtgaacgtctctgtgtcacagatgtgtatctctacaccatgttaggctgggcgaaacgtgttggattggatgttagccacctcactcacttcaagtcctttatcgaacgtgtcgaagcggataaaggtgtagatgctgtacgtgttcaggaaggcttaaaatagaacataggcgagaataattctcgccttttctctttcattctatctgttttttgattaaatcgatcagaagaggaaattcacaccatccttccctatctaaaaaatgcccacctgacggtaagcgaatataatctgctttcaaatgtttggctaattcatcactatatggatgtgggacaaccgtatcatctaacgcggcaacaacataagacttaaatgctaaacagcttggtgcaacagcataactatttgaaaacgaactcagttcaggaatcgtatccaatggctgataaaatcctgacacaaaaatagccgctttaggttttaaaaagtttctcgccaaaaagttaagccaagcgatacagcctaaactatgtccgacaacgatagtctcatcatcaatggtgatgtgtccttccaaatgtctcagccatttatctggatttgggttacttgaatctggcatattcaagcgataacactcaaccccgatttttgctaattcttgttctaaccacggaaaccaatgtttatccgccgatgcagtataaccgtgaacaatatagacttttgccataaaacctcctcaatacaagcggtctgattttgccataaatttgcaaaaataggtaaataacgaaatattttaaattagtgtaacttagactaataataaattaacattcatactgctaatagattcttgggcattttctagtaatcctttatcgcaaatgatctggtcaaatacggtgagaggatatacaaaaaaagtcgcaaattttccatatttagaagaatcagtgacaagaatatttttacgagaggcttctataattgctagtttcacaggaattttgttttcattaggcgtggtgagtcctttaagattccatgatgaagtcgagataaatgcgatatcaatagataagttttttaagaattgtgcggcaagcatgcctgttgtagataaattttctttacagacacttccaccaatgtgaatgatttcacatcgacctgagttactaagaaaatgagcgataacaaaatcattagtgataactaaaatgtcattgcgttctgctatttgatgtgcaatttctagtgtagttgttcctgcatcaaggtaaatcgtggcattatgaggaatctgttttgctgctgcaacaccaattgcccatttttggtcgtgaaataattgagatttatcactatgcgtgggttccgtcgtcagtctctcaagtgattgaaccccccctgatactgatgatattttcccttcttcttccaatttttgaatatctcggcggatagtcatatgtgagacatttaaacggttggcaagaaaattaacgcttgtactgccaaaactattaacaatttgaataatctgtctttgtctttctgctggaatcatattctttccttacattatcttcggcctgttcattatacccatctatgttaccttgagctattaacaaaatttaacaattttgttaaattttgtgagctttgtcacagattttatttttattgttatgtatgatttgtaaacataatttatgagacatcattttatgaggagttagttatgagtaaatctacttatagtatcgcagtaattgggcttggtgcaatgggaatgggggcggctaagtcttgtattacaaaaggattagatacctatggtattgatctgaattctaaagcgttagaaacactaaaatcctttggtgcaactgatattggggagagtgccattccttttgcatctaaattagatgctgtattactacttgttgtgaatgctactcaagtgaaatcaattttatttggagagaagggactagcacctcaccttaataaaggtactgtggtgatggtttcatctaccatttctgcccaagatgctaaagaaatttcacataaattaacagagttagggttattaatgttagatgcacctgtttcaggtggggcagctaaggcagctaatggtgatatgactgtgatggcatctggttctaaagaagcttttgagaaattagagcctgtgttagatgcggttgcaggaaaagtttataacattggtgaagaaattggacttggagctacagtcaaaataatccatcaattattagctggtgttcatattgcagcaggcgctgaggcgatggcattagcagcaagagcgggaattcctttggatttgatgtatgacgtggtgacaaatgctgcaggtaattcttggatgtttgaaaatcgcatgaaacatgttgttgatggagattatacaccattatcaatggttgatatttttgtcaaagatcttggtcttgttacggataccgctaaagcattgaaattcccacttcctttagcaagtactgcattcaatatgtttacatcggcaagtaatgctgggtatggcaaagaagatgatagtgcagtgattaagatcttcgatggtattgagttaccaaaaaagggggagaaataagatgttaggtgttattgcagatgattttactggggcaagcgatattgccagttttttagttgaaaatggattaaagaccattcagatgaatggagtgccaacatcaaatttagtagaacctgttgatgctgtagttattagtttgaaatcacgctcgaatccagttaatgaggcgattgagcaatcattagatgcgttgaaatggttacaaaataatggcggaaaacagttctattttaaatattgttctacttttgatagcacagagaagggcaatataggtcctgttacagatgcattacttgatgcattgggtgaggatttcacaattatttgccctgcgttaccaatcaatgggcggaccatttttaatggttatctctttgttggaaatgtattacttaatgaatcgggtatgcaaaaccatcctattacaccaatgaaagatgctaatctcgttcgtttaatggatatgcaagctcgtgggaaaacaggtttagtaagctgtgctgaattattcaaaggtgctgactatgttaaacaacgttttatagagttaaaacaacaaggctatcgatatgctgtagttgattcagtggacaatactcagttagctgttttagcagaatcgattgaaagttttaaattagtgacgggtggttctgggttggctgcatatatggctgaaagaatttcaggcggtaaaaaaggtactgatgcctttacaccaaccaaagcgaaaaccgttattttatcaggatcttgttctgtgatgactaataagcaagttgggtattatcagaaacatgcacctagctatttcttagaggctgaacaagctatcaataatcctgaatatgtagaacagctctaccaatgggtgatttctcatctaaaccaaccgcttgctccaatggtatatgcaacagtccctcctgaaacattaaaaacaattcaagccaaatttggtgcagagaaagcgagtcatgccatcgaaactacctttgctcgtttggcagaaaaacttaaagatacaggcatcactaattttattacggctggaggagaaacatcgagcattgtggttcagcaactaggtttttccggtttccatattggtaaacaaattgcaccaggggttccttggctaaaagcggtagaagaaccgatttatttagcattgaaatcaggtaactttggaaaagaggatttctttaaatttgctcaggagatgtttgtatgacggatttgacacaaaaaattcaaatggttgaactcgcgaaatcattatttgatcgaggatacacagtaggtggtgctggaaatctttctgtcaagcttgatgataatagggtgcttgtcacacctacaggttcatctttaggacgattagaggttaatcatttatctgttttagatatgaatggaaatctcattgagggtgataaaccttccaaagagtctgtatttcacttagcactttatcaagcaaatcctcagtgtaaagcgatagttcatttacattcaacttatctcaccgccttatcttgtttggaaggaatagatactacaaatgcgatgagagcttttacaccatactatgttatgagagttggacaacttgcagtgatcccttattacaagcctggtgatatcaatatcgcaagggagttgagtgaaagagcattacaggctaaagcttttctacttgccaaccatggtgttgtagtaacaggacacagtttagtggatgcagtggataacacggaagagttagaagaaactgcaaaattacattttattttgcaagggaaaaatattcgctatctctctgagagtgaagtgaaggatctagaaaatagggggaaataaaaatgcctaaatttgctgcaaatttaacgatgatgttcaatgaagtaccttttttagacagatttgaagctgctgccaaagcaggatttaaatatgttgaatatttatggccttatgaatatgacaaagaggtattaagacgtttattagaccaatatggtctgaaacaagttttatttaacactgcagcaggtaatgtatctgctggtgaatggggtgtttctgcaataccagggcgagaggctgatagccataaggatattgatatggcactggaatatgctttagcgctaggttgtgaaaatgtacatgtcatggcagcagttgtgccagaagatcaggatagagaagcatataaacaaacattcattgagaatgtgcgttatgcggcggataaattcaaaccttatggcattaaagtattgttagaagcgttaagtccagaagttaaacctaactatctgttaaaaagtcaatttgacaccttggaaattgtagaagctgtgcagagagaaaatgtatttgttcagctagattattttcatgcccagaacgtggatggcaatttatctcgattgacagataagttggatagcaaatttgctcatgtccaaattgcatctgtaccagatagacatgagccagatgaaggtgaaattaattatgcttatattttcaacaaattagatgaaatcggttatgaaggctatgtaggttgtgaatacaaaccaagagcaaatacggttgatggcttgcaatggtttcaaccatacaaaaatcgttaatctatttagatgaaagagaaagaaatgaaagtagtaattacaggtggacaaggttttttaggccaaagacttgctcgtactttattaaatcagcattcagagaaaattgatgagcttgtgttaattgatgtagtaaaaccgattgctccaaatggtgattcaagagttcgttgtttagagatggatttaagaaatccagaaggattagatcaaattattacaaaagaaacagatgctatttttcatttagctgcaattgtgagtagccatgcggaacaggatccagatttaggttatgaaattaatttccttgcaacaaggaatttattggaaatctgccgtaaaaataatcctgctgtacgttttatattctctagttctttagctgtttttggtggtgagttacctgatgtaattgttaatggaactgttgttactccgcaatctacttacggtacacaaaaagcaatgtgtgagttgctaattaatgattacagtcgtaaaggatttgtagatggtattgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgacagcgtatgggttaaacgtgtaaaaatagaatgggacggtgtagaactaatcagcgacaacaaagaagaataccgcccaatcagaatatcagcagatgaagcccagaacctacaaatcatcgggcaagtggttcatatcggacacagcctaatttaaaaatttaaaatgggttttaaaatttcttaaacccattttaaaaaccgatcaaacctgctcaaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggttataaaaaagtaatctgcactcaaaaagttggactaaacaaccaactgattaatgtgtagattttttatgaccaaatataacaaactattcaaacaacaagtaatcgagttttatcctcaaaatggcaaaaatcgatctctcactcatcggcaatttcaactcaaagacacaacgctatgtcgttggatttcaaaatataatcataatggaatcaatgagttagaggttgtcagcaagaatcaaaatgagggcttaaagccttgtagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaaataaaaacaacctgtatcaaacaagaaacacaggttgttatatcaatcttgtactaaatcttcgaatatatctcagctattgccaatattttttctttgaagtttgtccgatacctgggttaaaactatttgttggatcaagatgttgatagaatttacgtaaagtaggttttgcttcatacaaatgtcctacattatgctcagcaggatactgggcaccacgttggtcaagcaattctaacattttatgctctaatgctacgcagtcatgaccttttttcacaatataatcctgatgaaaaacatggcacataaaatgaccgtaatagagtttatggctaattttatcgttgatctctgttggtaatacttcaaaccattcactatcattgcggcgcaacgcaatatctaaagcaacaatatcctctacctctttttcatgaatagctctgtaacgtactgccgcagaagcaacagcaaatctgtgaagcattgccgcttgagtttcttccgaattacattcgaaataaccacctttagcactttctgcgaagtaggtttttaaatattctcttgcttctgtaacacctcccccccccattttaacgattaaatgatgttcatatttatctcgatattgacgaagacttaaaggtaaatgctgtggtaatactttagaaattaattgtaatgctttatcactcaaatggttaggtaaaaaatgatattttttagctaaacggtctactctcgcttttagtgcgaataacattggtaaacgatgagtacccagctttttaattacccaaaatgtatctttaccatattctgcagccatatcaaaagcatcacgatgaatatattctcctgaaattggtaactgctgaaaattagctagcatataacggcgaatatcattaagaacttcagttcgatttgttccaatataaaatacagccgtttctttttctgcaggaaaagtatctaaacgtacagcaaaaatagctaacttccctgcacttccggatgcttcataatgacgagccggatcagcattaaaacgagcgggtgaatcttcgtctatttgacgaacatgattacagtaagcatgatcatgtccttttccacattctagttgaatatccttacgttgataacgctgttcttgtagattttgtaaaatctcttcaggtgtttcacctaaatcaatccctaagtgatttttaagttctaattcacctttttcatttaattgagcataaagtgccatttcggtataagccggtcctcgttgtactaaagcccctcccgaattattgcaaacaccaccaataaccgatgcaccaatacatgatgagcctattacagaatgtgcttctctattgtgaggttttaatgcattctctagagcattaagagtagaaccaggcaaacacacaacctgactcgcattattaataagttgaattccattgattctcattgcattaataatcacgatatcccgatcataatcatcgccattcggtgtcgaaccccctgtcaaccccgtatttgcagcttgggtaatcactataacatcagctgcaacacaagcctttaatatttcccaaaactctagtaatgtcgctggacgtacaacggcaagtgcatttcctgatccaaaacgataaccacttcgataaacttctgttttggaggcttcagtaataatatatttctcccccacaatttgagtgagtgtactaataagcttctgggctgacacataaattccttatattggttaataattaacaaaattataacataattgtagaaatatctacattatgaagtcaaattcaacgaaaaaactcaattttttccaccacacttttataaacttgaaaaagattaattgggttaaaatcccttagttttgttttcccgaacaaaaagcaaaaaccccagtatctctactagggtttaaattaatgccctgatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagtttttttctaaatgttttgtttttcaccaaaaattaaaaacagcaaaacataacccattgattttaaacaaaattatttttcagcaaaattcagtatatttaagcgtttaaatccccaattctgcattaccttttctctttttaggaagtcttcgttgttttgcgtacaaaatgcctgattttctttgttttcgttattcacattcctcttcacatcttgtaataagctcactacacggttcgcaatcccattgcctggatcaacaaaaaaactcacccgtggtaatagttgttgcaactcttctttgactaatgggaaatgtgtacaacctaaaatcaccgtgtctaatgtcgggtgtgattgccattctgcaacaactttttgcaggcgttgcatatccaccgaccccgtttgctgtttttcttcgacaatttccaccaagtctgtggaaccaatgcgttctaccacacaatcttttgcatagcgttcaatcaactcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacataaggacgagttaccgtgcctttggttgcaagtaagccaatggttttggtttgggaaatttgggcagcaggtttaatcgcaggcacagtcccgacaatcggcattgcaaaccgttctcgcaaggcaggtagcaccaccgtactgacagtgttacaagcaacaaccaccatatcaagcggatagttttctgcaattttttgcacaatacctaccgctcgttcgatcagcaccgcttctgatttttcagaataagggaaatacgcgttgtcaaaacagtagagataatgggcatctggcagattttcacgaatagcatcgtaaatagtcaaaccacccattcctgagtcgtaaagaagaattgttggtttcattatattttgtaattaaagaacttcgagcgaatgctacgcctttcttgatgtggtttcaaatgaaaattgtggcagaaacagctctcgaatttctaacggataacctttgagtagcaatgttgaacggcgagcatataagcccgtctgcttgtcttggctccattccaaagttaaacgctgtggattttgcggaaatagccacaaaccaataggattatctcctagggttaaaacggcttgtgctacattctcaattgtttcttccactaatagcgtttgagcaaaaatccacgctttatcatcaccacttaacaccacttctcgcacccacatttttgcaaaatattgctcaaatccgaccgcttgccagccctgttgcaccacatcaacggatagcctttggcaaatttgttgcaacttttcagttaaagagtctgtatgtaacagccattctgcaacttggcttggcaaacccgtttccgccgtttgccaagcagatgtggctaataaggttcgatactgctcgaaatcctgcatttaagcccctagctgtttgagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatctgctctaacacatcatagccttgctgagtaaagtgcaatccgtcgtgacacagatttaagtccaatttgccttcttcattagcaaaggcattccacgttttcacataacgaatatcggaagggcaatgtgcttcaaggtattgatttaacgccaaaatcgcaggattgtctgtggtcgcaatgttattcacaggggttgcttctaataaatagtaacgagatgttggggctaacgttttaaaggcggacacaatctcgttaatccagcctaacacttgcttcggcgaataatcaggttcttttacaatgtcattcacccctaaaaagataaacacatcttcgcctaactgtttgattaaattacctttaacaatcaaatcaaggtattgacgagtgctagtaccagataaccctaaatttgccaccgttttacctgcaatattcggcgtgccttgttccatatcagaccacatatcaaatagtgagtgaccaacaagggtaatttgagctgttttatcaaactcagtctgtttgcttaatgccctgtctaaaatgtcttgatctgttttcatatgttatcctttgtctaaagtaatgattaaaaaccatcctacacaacaaatcccactttcttatacacgtcggctaaggttgctttcgcttttgctctcgctttttctgcaccttcacggtaaatactttcaagcaatgcttcgttgttacggaaatggtgataacgttcttgaagttggcttaacattgcggaaacttcgtcggcaacggcagtttttaagtgaccgtacattttgccttcaaattctgtttctaattctggaattgtcttgcctgtgacgcttgccaaaatatcaagtaggtttgatacgccaggtttattttgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcgtaacgtacaacaggtggctcatcaccgtcggtcattgcccgtttgatttttttcgccactgattttggatcttctaataaaccgataacgttattacggttatcatctgattttgacatctttttcgttggttcaagtagcgacataattctcgctcctgttttggcaataaagacttcaggcacagcgaagattggctcaaggacatttccctctgcgtcttttttgccgtataacgcattaaaacggttagcaatatcacgggtgatttctagatgttgtttctgatcgtcgcctacaggcacttgatttgcttggtacagtagaatgtctgccgccattagcactggataagtaaataagcccacgtttacgttatcttcgtggcgagctgatttgtctttgaattgtgtcattcgccccatttcgccgaagtaggtataacagtttaagatccaagcgagttggctatgttcaggaacgtgggattgaataaaaatagtgcttttgactggatcgataccacaagcaaggtaaatggcgagtgtatctaaggttgctttgcgcaacgcttctggatcttgtcgcactgtgatggcgtgtgaatcgacgatacaaaatagacattcatattcatcttgcattttaacccagttacgtaatgccccaaggtagttacctaaacttaattcgcccgatggctgtacgccactaaatactattggttttgacataatctttctctttttagtaaaaaatctagcggtgtgattttggcagaaatttgctaaaaatgccaagcactcaaccgcttatcattttaggaattaatcctcaatccccaaactttcccaaatctcatcaacacgtttgacgacatcgggatttttggtaatcggcgttccccattctcgttgggtttcacctgcccatttattggtggcatcaatgcccatttttgagcctaatcctgcgataggggacgcaaaatcaaggtaatcaatcggtgtgttttcgattaatgtcgcatctcttgctggatcgcaacgagtggtaatcgcccagattacatctttccaatctctcgcattgacatcatcatcacacacaatcacaaatttggtgtacataaactgccgtaaaaacgaccaacaccccatcattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcctgcgtattgctttttgatcgtgactaccgctaggcgataagaacagccttcgggcggtaagtagaaatcaacgatttcagggaattgcttctgcaaaatcgggataaacacttcattcaaggcttcgcctaagaccgcaggttcatcaggtggtctgcccgtgtaggtggaatgatagatggcatcttttcgcattgtaatatgcgtcacggtaaacacagggaaatactcttgttcattgtaatatcccgtatgatcgccgtaaggtccttccaatgcggtttcgttaagatcgatatagccttcaagcacaatctcagcactagcaggcacttccaaatcattgctgatggatttcaccacttcagttttgtgtccacgcaataaccctgcaaaggcatattccgataaagtatcggggatcggcgtaacggcggctaaaatcgtagcaggatctgcccctaatgcgacagaaacaggaaacggcttatcgggattagcttctttccactcttggaaatccaacgcaccgccacgatgcgatagccaacgcataatcagtttatttttagtgattaactgctggcgataaatccccaaatttaaccgctttttataaggaccttgcgtaatggttaagccccaagtgacaagcggtgcgacatcaccttgccaacagtgcataatcggcagttgatacagatcgacatcatcatccgagatcaccacttgctgacaatctgctttattcaacaccttacttggcatattcagcacttgcttccactgtggcaactgtccgattagatctttaaagccttttggcggttcgggttcttttaagaacgccaacaacttgcctagctctcgcaaggctttggtatcttcttgtcccatacccattgccacccgttccggcgtgccgaatagattgcacagcacaggcattttgtagcctttcgggttttcaaataagagagccggaccacctttactcaaagtacgatccgcaatctcggtcatttccaaataaggatcgatctcttgagtaatacgcttcagttcgcctttttgctcaagcagatcgagaaattctcgcaggtttttgtatttcatttgattctccattgcaagaaaatgcaattttaataaaatttctaatctagagaaataaaagagctgaccccagtatgatactgaaatcagcccattaaaactatctatttaaagatatagccacaatatttggaatataatgcaataaatacaactaaactatttacttaaattatcaaagaagtttttcacccctttgaaaaaaccttcgtgttttggtcgatgttgtcctttgccttccagactttcttctaatttacgtaacaactctttttgttcttcattaagcgatactggcgtttcaataatcactttacagattaaatcccctgcatagccgcctcttgcactggttacgcctttaccacgcacgcgaaacagtttacccgtttgggtttcggctgggattttgagtttcacgcgaccgtctaatgtcggcacttcaatttcgccacctaatgccgccattgtgaagctgatcggtacttcgcagtaaagatttgagccgtcacgcacgaaaatatcgtggtctttaacgtgaattaccacatataaatcccctgctggagcgccgttttcccctgcagccccttcacctgataagcgaagttggttgccagtatccacgccagctggaatggtgaccgaaaggtttttagttttctcaacacgtccgtcaccgtggcaagatttacacggtttctcaattttcttacccgtgccgtgacaacttgggcagacagtttctgtcataaagaaaccttgttggcgacgaactcgtcctgagccgtgacagtgtggacaggtttcgactttgcttcccgcttcagcaccagaaccgtggcaagtatcacattgaacaagagttcgaatgcgaatatcttttttcacaccacgcacggcttcttcaagggtgatttctagatcgtagcgtaagtcatcaccacgtacgacacgttggcgacgagcgccaccaccaaaaccaccgccaaacatttcgctgaaaatatcttcaaagccaccgaaaccgccaccaccaaatccgccgaagccaccagctccgccaccgtgttcaaaggcttggtgaccatattggtcgtacatcgcacgtttttcgttatcgcctaatacttcataggcttctttgatctctttaaatttttcttcagcttctttgctgccttggtttttgtcagggtgatgttttgccgctaaacgtttataagcacgtttaatctcttgttcactcgcccctttttgtaagccaaggacttcgtagtaatcttttttactcatagtattttttgtaaatttttaagaaaatttgaccgcttgtaacctaatttcgttatattctgttttctaatgaaaaaatctgcttatttagaatttcatcaattttggctcgttccaaccctgaatttatcaaagtgagttctaacgttttcatttgttgtttaaatgcttcttttgctttatgtacattttcagcaataaaatcagcattgagatcgctttcgatacgataaaatttaatgttggaaacacaaggataaaaccaatcaaatttagcagttaaatcctgaatagcaatagtgccatgtgcttcactaataccttctttccccaaataaacacttccttgtagatgttcaaaaccgtgtttttcaagcgtatttcgaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtagtaagcgttattatgggtatttccatggtaattatcttttagacaatttgtatccatatcaaaagtgattaggtatctactcatattcaatttccaatagttagattttatctaaaatgttttttgatgataattaggacataatcaacgcagttttcaacggtatcatcaccatttaacttttgagcctgtatttcgagttttctttcgtagatatacaccaaaagggcgtgttgccacgccctttgtagggacgcagtgcctgcgtccgtggacacacgcagtgtgaccctacccgtaaattacttgttgtctttcacttcttcaaactcagcatctaccacgccgtcatctttttgactttgttgggcttgttgctgaccttgttgagcctgagcttgacctgcttggattaacggctcagacgctttcactagggcttcgattttcgcttcaatatctgctttatcttcgcctttcgccgctttttctaatgccgctaccgcttcttcgatcttcgctttgtctgcatccgcaaggttgctacctgcttcagcgatctgtttacgggttgagtgagcaatcgcatccgcttggttgcgagtttgaactaactcttcaaacttacggtctgcttctgcattcgcttccgcatcacgcaccatttgttcgatttcagcatcgcttaagcctgaagaggcttggatcttaatttgttgctctttacctgtgttcttatcttttgcagacacattaataataccgtttgcatcaatatcgaatgtgacttcgatttgtggcataccgcgtggtgcagggttaatgccttcaaggttgaactgacctaatgatttgttatcagaggcacgtttacgttcaccttgtaatacgtgaatggttaccgcactttggttatcttccgccgttgagaacacttgcgattttttcgttgggatcgtggtgtttttctcaattaaagttgtcattacgccacccattgtttcgatacctaatgataacggggttacgtctaacaataatacgtctgttacatcacccgctaatacgccaccttgtacagccgcaccgatagccaccgcttcatctgggtttacgtctttgcgtggttctttgccgaagaagtcagccacttttttctgtactaatggcatacgggtttgaccgccaactaagatcacatcgttgatctcagatacgcttaaacctgcatcagctaacgccacttttactggctctaatgagcggtttactaaatcttctactaatgcttctaatttcgcacgggtcacagttaatactaagtgttttggacctgttgcatctgcggtgatatacggaagatttacttcggttgattgtgctgatgaaagctcaattttggctttttccgcagcttctttcacacgttgcattgccattgagtcattgcgtaaatcgacgccttgctctttttgaaattcttcaacaaggtagttaattaaacggttgtcgaagtcttcaccacctaagtgagtatcaccgttggttgcacgcacttcaaaggtttgttcgccatctaagttatcaatttcgatgatagacaagtcgaatgtaccaccacccaagtcatacactgcaacaatttggttttcttttttagagtctaaaccgtaagctaatgccgctgctgttggttcgttgatgatacgtttaacttctaaacctgcgatacgacctgcatctttagttgcttgacgttgagcatcgttaaagtaagcaggcacagtaataaccgcttcagtcactggttcacctaagaaatcttctgcagttttcttcatttttttcaatacttccgcagagatttgcggtggagccattttttcgccttttactgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctccattgtccgctttggtaatctcaaacggcataatttcaatgtcacgttgtacttcagaatcagtaaaacgacgaccgattaaacgtttaatggcaaataaagtatttttcgggttagtgatcgcttggcgttttgctggctgaccaactaaggtttctttgtctgtatacgcaatgattgacggagtagtacgcgcaccttctgcattctcaattacacgtggtttgtcgccatccattactgcaacacaagagttggttgtacctaagtcaataccgataatttttcccataatttgattcctctaatataaatttggttacttgtgggactgaaccatcatattcaacgtagggacacactgcgtgtgtccacaggctgttcctactgtgtatagatggataaaatccgccactttgttaaaaaagaaacgggaagttgtgctacgttcccgctcagacggaacaataaatagggataaaaatgtgggcttcaaggggaaaactaaaaaaatttaaaaaatgtgtattaacacacacgcactatttctcactacggcacaatcaccgtaaacacataagccgccatattaaccaaaagcactacgccataaagcatattcgatttgccgtgattaagagaaaccatcacaacgaaagcggacaatgccagtagcaccattgatttccaatctaagcctaacaccatattaatatcaaatagtaagcagacgatcacaacagacggaatagttaaaccgatactggctaacgctgaacctaacgccaaattcacactggtttgtaatcggttacggctggctgcggtcaatgctgccaaaccttcaggcatcaaaacaacagcagcaataatcaccccgactaaagataacggcgcacctgcagcaaccaccattgtttcaatcgcaggggaaagccctttcgccaacattacaacgacacctaaacagatcaccaatagcaataaactgactaatgccactttagtcgaaggtggctctgcgtgatggtttggattatcatcatcggctaagaaataatcacgatgacgcacggtttgcatcataataaaagagaaatataaaacgagtgacgcaatcgcaacaaataccaactgagagctggtataagtcccccctgccgagctggttgtgaaattaggcaaaatcattgttaataccaaaatagacactaaggtcactaaagcggtactcactgattttttatgaaaaaattgaacgtgatgtttaataccaccaattaataagcaaccacctaaaatcccattcaaaatcaacataatcgccgcaaatacggtatctctagccaaataggtagcattgtcaccgcctgcgatcatcagcgacacgattaatgccacttcaataatcgtaatagcgagtgctagaataatagtaccaaacggctctccaactttatgtgctaccacttctgcgtgatgaactgcagaaagcacactaccaatcaataacgcacctcctccaagttgtagccaaatgttctctttcacgccaacaaaatagatagcccaagctgcaagcggtaagatcaccgaccaaattggcaaaggggaatgggaatgtgtcgccataatgtcttctcctttatttttatcatttaacaatcctgctcttttgtactcataatctcaataatttgtctatccatatagaccatactttttgtcgtaatcgcacataggttattgattgatttatcaacactatgttctacgataccttcattgcctgtcactcggctattatctaatgccactaacacagccttataggcagaagatactcccgttgaaactttcatcgcacagctgtttgctgccccgtcacacaatacgccactgatgtcgccgatcatactgcaaatcgccatactaatggcattaaaattgcctttcaacaaatacgccataccagcagcactgcccattgccgccgtagtcacggcacaaagagcggatagttttggtaatttactgtgaatatagatcgcaatagtatgagaaagaaataacgcacggatcagttgctcatcatcagcattcacaaagcgtgccacaatcactgacggcattgttgccgcaataccttgattgctcgatccagaattgctcatcgcaggcaacaacgcaccgcccattcgagcatctgacgctgtcgtggtttcaatcacaatacgtgataataaatcatcagacatcaagccaagttcaatctgttttttcaaagttcgtccgatatgcaaaccatactctttttccaaaccttctttagataacgcagaatttaatttagccgcttcggcaataaaggcaatctgttcaagaggaacttccatcgcaaattgataaatctgttcggcggaaagttgattgaaaaagtgataatcgtctgctatttcaaccgcttgcgtttgttgctggaacaacacttccccatttttctcaatcaacaccacattggtatgggtatcttgaatacagactttgacccaacccgtttcgcctaacaacaaggcttccgagtaaagcggaaaatccacatttgcaatatctacactcacttggtttgcatctaacatcgctttcgctttggcgacatcgtcagcttgaatatgtttcaacacttccaaacctgccgttgcatcacctgcaatcgccccacagccgccacaatcggcaatcccaccatacctgttccaggtacggtaacccccatactgtttttcattaaatttggggacactttagcctgaatttgaacaggctcactgcccaaatgtgatttcgcaatcgcagacgctaacgccaacgaaatgggttctgtacagcctaatgctggggcaacatctcgtttcacaatggcgattaattgttctgcaaattcaaatttattcattcttttttctctttagtaaaatttctctctattctaaccgcttattgcataatcaaaaagtaacttttttcacttgtctttagttgaataaaaatgcattattttaacataattatttattatgataatgtctgaatttattttttataattatcacttgaacgcaaacgtttgctctagtaaacttagtcgcctattcctgagtaagagattaggcagcttgcaaaatgacagccaaaaatttcaataattaggagtacatataatgtttgaacctgccattttagttcttgccgatggttctgtttttcatggaaaatctattggttatcaaggacataccattggtgaagtggtctttaataccgcaatgacgggctaccaagaaattctcaccgatccttcatacactaatcaaattgttacattgacttatccacatatcggtaatacaggaacaaatagcgaagacgaagaagcagataaagtgtatgctgcaagtttaattattcgtgatcttccccttattcatagtaatttccgtgctaactcttccctttctgattatctcgttaaacataaaatcgtcgcaattgccgacattgacacacgccgtttaacccgaattttgcgtgataaaggcactcaagcaggctgtatttatgttggtgatgatgtggctaaagctctcgaacttgccaacagtttcggctcaatggcagggcaagatttagccaaagaagtgacctgtaaagagctatatcaatggaaggaaggcgaatggcaactcggcaaaggttatgtgcaacaaactacccctgaatttcacgttgtcgcttacgattttggcgtaaaacgtaacattttaagaatgcttgctgaacgtggctgtcgtatcaccgttgtgccagcaacaacttctgcagaagcggtattagccttaaatccggacggtattttcctatctaacggtccgggtgacccagagccttgcacctatgcgattaccgctattcaaaaattattggcaaccaaaaaaccgattttcggcatctgcttaggacatcagttactcggattagccgctggtggcaaaacgaagaaaatggcattcggacaccacggtgcaaaccaccctgtgcaagatttagacacacaaaacgtgctgatcaccagccaaaaccacggttttgaagttgatgaagccagtttgccagctaacgttcgtgtcactcaccgctcactctttgacggcacagtacaaggcattgaactcaccgatcaatccgcattctcgttccaaggacacccagaagccagcccaggtccacacgatgtggcatacctgtttgaccgctttattgatgaattgagaaaggcgaaagggtaataagcggtgaggtttgaagggaaatttgcaaaatcttgtgaagatgtgaccgcttgtaactgatttttataagtgagataaataggaaattttcttcgatctcactcccctctttagcaaagagggggatcagatcgaaggtataatcgcattcaacaacagagaaaaaactatgccaaaacgtacagatataaacacgattttaattattggtgcaggtccgatcgtgattgggcaggcgtgtgaatttgactactcaggggcgcaggcgtgtaaggcgttgcgtgaagaagggtataaagtagtgttggtgaactcaaacccagcaaccattatgaccgatccgaatatggcggacgtgacctatattgagccgattgagtggcgaacggtggcgaaaatcatcgaaaaagagcgtcctgatgcgattttgccgacaatgggcggtcaaacggcattaaactgtgctttagatttatctcgcaatggggtgttaaaacagttcaatgttgagctgatcggggcgagtgaagatgcgattgataaggcggaagaccgtggtcgtttcaaacaagcgatggaaaaaatcggtttgtcttgcccgaaatcttttattgctcacacccttgaagaagccttgaaagtacaggaagcggtcggtttcccaacattaattcgtccatcatttactatgggcggttcaggtggcggtatcgcttataaccgtgatgaatttttagcgatttgcgaacggggatttgaagcgtcgccaacccacgagttattgattgaacagtctgtacttggttggaaagagtatgaaatggaagtggtgcgtgataaggcggataactgcattatcgtttgttcaattgagaacttcgacccgatgggcgtgcatacgggcgacagcattaccgttgcacctgcacaaactttaaccgataaagaatatcaaattatgcgtaatgcttctttggcggtgttgcgtgaaatcggcgtggatacaggcggttcaaacgtgcaatttgcgatcaaccctgaaaatggcgagatgatcgtaattgaaatgaacccgcgtgttagccgttcttctgcccttgcatctaaagcgacaggcttcccgattgcaaaagttgcagcgaaattagcggtcggttataccttacatgaactgcgtaacgatattacgggcggtttaattccagcttcttttgaaccaacccttgactatgtcgtaaccaaaattccacgttttgcctttgaaaaatttgcgaatgcagacgaccgtttaaccacccaaatgaagtctgtgggcgaagtgatggcaatgggaagaactttccaagagagcttgcagaaagcgttgcgtggcttagaaatggggatttgtggctttaacttgctatcggaagagcctgaaaaaatccgtcgtgagctggcaaacccaggtccgaaccgtattctttatgttgctgatgcttttggtgcaggctttagcttggacgaagttcatcactattccaaaatcgatccgtggttcttaattcaaattcaagatttggtgcaagaagagcttgctcttgagaaaaaacagttaagcgatttggatcgtgaagaattacgtcgtttaaaacgcaaaggtttctcggataaacgtatcgcccagcttactaaagtcagcgaaaaagcggtgcgtgattatcgccatacccttggcattctgccggtttacaaacgtgtcgatacctgtgcggcagagtttgcttctgatacggcttatctctattctacttacgaagaagagtgcgaagcgaacccatctgatcgtaaaaaagtgatgattttaggtggtggcccgaaccgcatcggacaagggattgagttcgattactgctgtgttcacgcatctcttgccttgcgtgaagctggttatgagaccattatggtgaactgcaaccctgaaaccgtttcgacggattttgatacctctgaccgcttgtattttgagccattaacgctggaagatgtgttagaagtggtgcgtgtagaacagccgtggggcgtgattgttcactatggcggtcaaacgccgttaaaactggcaaatgctttacacgaaaacggcgtgaacattatcggcacatcagcaaacagcattgatgcggcggaagaccgtgaacgcttccaaaaaatcctgcacgatttgaacctaaaacaaccagctaaccgcacagctcgtaatgcacaagaagcagtggcgttggcaaatgaagtgggttatccgttggtggttcgcccgtcttatgtacttggcggacgtgcaatgcaaattgtctataacgatgaagaattgaacaaatatatgcgtgaagcggtgtctgtgtctaacgacagcccgatcttgctcgaccacttcttaaataatgcgattgaagtcgatgtggactgtatctgtgacggcgaaaacgtggtgatcggcggtattatgcaacacgttgaacaagcaggtatccacagtggcgactcggcgtgttctctgcctgcttactcgttaagcggtgagatcctcgatgaaattcgcagacagaccaaagaaatggcgtttgcccttggggttaaaggcttaatgaacgtacaatttgcggcgcaaaatgatgtggtatatgttcttgaagtaaaccctcgtgccagccgtaccgtgccgtttgtgagtaaagcgacaggtcagccgttagctaaaatcgctgcacgagtaatggcaggggaaagccttgcagaactcaatgctctggaagaggtaattccacaaaaatacttcgttaaagaagcggtattcccattcatcaaattcccaggggtagatacaattttaggccctgaaatgcgttcgacaggggaagtaatgggcgtgggcgaaacctttgccgaagccttctttaaagcacaattaggcgctggggaacgtattccaagaacaggaaaagtgttcttatcggtggataacaacgacaaaccacgcttgttagatgtggcaaaacgtttacaagagcaaggttatggcttatgtgcaacactcagtacagcgaaattcttgcgtgaaaacggcgtggcagctcaaatcgtcaataaagtgcgagaaggcagaccgcatatcgttgatgcgattaaaaacggagaaattgcgatggttatcaacaccgtaaacggtgaaccagaagtgattgccgacagccactcaatccgccgtaccgctctgcaacagcgtgtgcctgtctataccacgattgcaggggccgatgcgatttcctatgccgttgaacatattaacgagtttggggtgtattcggtgcaggaattgcatagtaactagattataaaaagaagagcttgaatatactttacaaaactaatgttattcaagctctttactaatctatttagacagattattaatatggatattaggcatagtacacaattttaataaataataccccaatactgcggagatacctgaaccaattaagattcctaaacgagcaagagagataaattgaccgtcagcttcatcgccaccaaaagcaagtcctgccaagaacattgacattgtaaagccgataccacaaaggatagaaacagcgaagatttgtttaaaatttatcccttctgataactgtgcgatacccaatttcacggcaaggaagctaaagctaaatacgcctaaggttttacctactaataaacctaacgcaacccccattgtaagcggtgagaataatgtgcttaagctcattcctgctaaagatacgccagcgtttgagaaagcaaatagcggtaaaatcacaaacgaacaccacggtgcaagaatatgttcaaaatgagccaatggttcttccccatttttaccttttaatggaacgcagaagccaataattacccccgctaatgtagcgtgaacccctgattttaatactgaagcccataaaattaatccaacgaccatataagcacaaattgccgtaactcgcatacgattcattatgattaaagcagtaattgctatgactgctgaaatcagggctgtggtacttaattcgtgagagaaaaagatagcaattacgacaattgcccccaagtcatcaataatcgctaatgcgagtaggaaaattttcaaagcaaatggcactcgtttgccgagtaatcctaaaactccaagtgcaaatgcaatgtctgttgccatcggaatcgcccaaccttgctgaaattctggcgaatcactattaatcaatgtgaaaacaagagctggtacaatcattccccctaatgcaccaatagcggggaaaattgcacgttggtagctagaaattgctccaaccatcatttcacgcttcacttctagccctataaggacaaaaaacactgccataaagccgtcgtttacccacattaacaacggtttatgaatactgaataagccaatctggatactgacaggcatacttaaaaaatcaaagtagaggtctttcaagggcgtatttgcaaacagcattgctaacattgcaaaagcaagcaataaaataccgcttgcagactctagttgtaaaaattttcggatatgctggatcattctgttaacctcttgttatgtaaaattcgtcaatctttcttaaatctttttttcttttaacaaaatcagcgtgtaagatcaaggcgaagagggcagatactgcagaaaatttgtaaaatttgtttgatcaacttcacgaaaagcagcaataaaagatttgaatttatgtttggggaaatttctagattagccttgatctttttggtatttatcgctagaattgcaactcttttttataatcctcgtttggcttatagtcaatttttaatttttaggtagatagcaaatgaaacgtacatttcaaccatctgtattaaaatgcgctcgtactcacggtttccgtgctcgtatggcaactaaaaacggtcgtcaagtattagcacgtcgtcgtgctaaaggtcgtaaaagcttatctgcataatggcagataagtcagccaaaacactcagtgtgaataagctaactttttctcgggagctacgtttgttagctcccgttcaatttaaagcggtttttgaactgcctctccgtgctagcacgcctcaattaacccttttatctcgccaaaacgatattgaacacgctcgaattggtcttactgttgctaaaaagcatctaaaaagagcccacgaccgcaatcgtatcaaacgcattgtgcgagaaagtttccgcttgaaacaacatcaacttcctgcttacgattttgtctttgtggcaaaaggcggaattggtaaactcagcaaccaagaactatttgaaaccttggataaactatggcaacgccacattcgcctcgctcagaaagcacaacaggaacaacatcaaaactaagccctttggcttatgtaatgctcgcctttgtgcatttttaccgctatgtcattagcccattaattggaccacgctgtcgtttttatcccacctgttctacttatgccttagaagcaattaaaattcacggtgccataaaaggtggctggcttgctctaaaacgtattctacgttgcaatccattgagcgaaggaggagaagatcctgttccaccgaagtgtaattgcggtacaaaacataaataatattgtaggttgggcagtaatgctcaacttaatctatcttgcccaataccaacttacccgcaaaacgttgcgttaattcatgctgaaacagttccacttgtgtggggttaattgctaagattaattccactttatcactaaattgttgctccaccagctcaatatcccgctctacaatcaaatgttgaatcgtattaaattgctcatattcacactgcaagcggtaagatttgcgtaaaactttgcgaattttttcgacttgcaatagcccttgttgtacaccattgccataggctttaacgagtccgcctgtgccaagcaaaattccaccgtaataacgcactaccactgcactgatttcccccaagcctgaacctagcaagtaattaagcattggtttacccgctgtccctgaaggttcgccatcatcagaaaagccatattgctgtgaatcattcggctgccctgcgaccgttgcccagcaatgatgtcgagcatgcggatgtaaagctcgtatttcagcccaaaaggctttggcttgttccattccttctgtatggcgaatgtaggtaataaaacgactttttttgatctcttcttcaaagatcacttctgctttggggataaaaaattccatattctcaactggttaattcatagagttctatcatactttaatgatgagatttgataaatctctttcaaattgttaaaaaaatgtgaaatcattcaagtttttaagagaaaacgtttgcataacagaaaaaagtcgagtatatcttatatcgttttcctatttgagttataggtcaaacgcaacatcttacttttcccaatcctgaatttttagaggaaatagacatgaaaaacttttttaaattatcgttagttgcaagtttagcaatgggttctatggcagctcacgcagaggacaaattcgtcactatcggtactggtggtcaaacaggcgtttactatgtagtgggtcaatcaatctgccaattagtaaaccgtgacatagcaaaaacgaatgtgaaatgtaatgcgccatctacaggagcatctgttgcaaacttgaatgcgattgccgataaacagatggaaatgggtattgctcaatcagactggcaatatcatgcttacaatggctcaagctcatttaaaggcaagaaaaacgacaaattacgtgcggtgttctctattcaccctgaaccattcactgtaatggctcgtaccgatgcaaaaattgctaacttcgatgatttaaaaggtaaacgtgtgaatgtgggcgacccaggttcaggtacacgtgcgacaatgaacgttattttggctgcaaaaggctggacagataaagagttcaaagtggcttctgaattaaaaccggcagaaatggcatcagtgatgtgtgataacaacttagatgcaattacttataacgtaggtcacccaaatggtgcgttaaaagaagctgctgcatcttgtgatgcacacttagtgccggtaacaggtgaagcgattgataaattagtggcagatcacccttactatgcgaaagcgacgattccgggtggtttatataaaggtacagataacccagtagatactttcggtgtgtatgcaacacttgtaacttctgcggatgtggatgctgaccgtgtttatactgtggtgaaagcggtatttgataacttcgatcgtttcaaacgtttacaccctgcgtttgaaaacctaaaagaagaagagatgattaaaaatgcactttctgcaccattacacgaaggtgcaatccgttactataaagagcgtggctggatgtaattcatccgtttcttaatatgaaggcaggagtaaatcgcttcctgccttttgtcgttttcatcaagcggtcagatttggctgattttttgcaaatttttggttaaatctaaccgcttgtcttgggttttctcggaggagtttatgtctgctcaatccaaaactgtggattacgatgacctgcaagatctcgtcgcctcaaatgactcaggcggtcgtaacccgacaggttttagtaaaaaattaattattgttacagcgattttatggtcgctattccaaatttattacacttcgccgtttccgttttggctgcaagaagtggtgagagattggggctggaatctgaacgtggtggtagatgataccaaagcacgttctattcaccttgcctttgcgatgtttctcgctttcttgtctttccctgcatttgcaacatcaccaaaacatcgcattccttaccaagattggttatttgcaaccctcggggcattccttgcggcatactatattttcttttatgaagggctagttacccgctttggtgcgccgaatacgcaagatattattgctggctgtttaggcattttattattgttagaggcttgccgtcgtagtttgggtttgccgttagtgattattgcgactgtatttttgctttacaactattttggacaatttttaccgagtagttctattattagccaccgttctggttcattatctcaaatcattaaccaacagtggattacaacggaaggggtatttggtgtcgccctaggtgtttcaaccaaatatgtattcttattcgtatcattcggagctttattggataaagcgggggcaggtaactattttatcaaaacagcatttgcttatttaggtcactttagcggtggtccgggtaaagcagcggtagtttcttctgcgttaacgggcttggtttcaggttcatctattgccaacgtggttaccacaggtaccttcaccattccgatgatgaaacgtgtcggtttgagctcggaaaaagcaggggcgattgaagttgcttcatcagtgaacggacaaattatgccgccggtcatgggggcagcggcgttcttgatgattgaatacgtcaatatgccgtatagccaattgattgtgcatgcgttcttacctgcattaatttcttatattgctttggtgtatatcgttcaccttgaagcgcaaaaaatgggcttaaaaggattggatcgtgtcgaacctgtgagcccaattttaatcactttgcttaaagtcgtaagctatattttagtgacacttggcttggcaatcgcggtgcattatggcttaggctggattaaaaatgttacacctgattttgccttcttgattgtgtgtattctattggcggcagtctatatcaaattgattcaccgagtttcacaattccctgatttagaagctgatgatccaaattcaccggtcgtatcattaccacgtcgcaaaccaactgtgaatgcaggcttacatttcttattacctgttgtagtattaatgtggtgtttaatgattgaacaattctctccagggttatccgctttctggggaactgttgcgcttgcagtgattttagtcacacaacgcccattattaagtttcttccgtaatgatgtgggtaacaaagttgcgctatttaaacaaggcattcaagatttagtggacggtttggagtcgggtgcaagaaatatgattggtatcggtattgcaacagcaaccgcaggtatcattgtaggtgcggtatcgctcactggctttggcgtacagctttcaggtattattgagatgctctcaatgggcaatatcttattaatgctgattttagttgccatctttagcttaattttaggaatgggcttaccgaccacggcaaactatatcgtagtatcttcattaatggcattggtgattgtcgaagtcggtaaacaaaacggcttaatcgtgccattgattgccgtccacttattcgtgttctattttgggattatggcggacgtaacgccaccggttggtttagcctcttttgcagcggctgctatttcaggcggtagcccgattaaaactggtgtgcaagcattctactacagcttaagaacagcgattttaccgttcctatttatcttcaataccgatttactcttaattgatgttggttgggcgaaagggattctcgtctttatcagtgcaaccactgggattctgctctttacagcagcaacgatgaactacttctttaccaaaaataaattatgggaaagtttagtcttgatcttcgctgcctttatcttgttccgtccaggtttctttatggaacacatttcaccaacttcacgccatattgagcctgttcaaatggttcaggagttagagaaagtaccagcagggcaaaatttaacgcttaaagtggcaggagtaaacccttatggcaaaccgattgaattctactcacagcttacagtgcctgaaggtgcaacgggcgaagaacgtatcaaagcaatgggattaaccttgttggataccggagagaaaattgaaatcaacggcgaaatgtcaccgaagatcttaattgataatgttgaaattgattcaccagccgctaaagcaggtttaaactgggatcaaaccattcttgatgtagcgttaccacaaaactcgcttccaaaagaattaatgtttattccggctttcctattagcgatttttgtcggctggaatcagcgccgtcgcatgaaaaaataaggacaaattatgtataacaaacttctccttgcgatcgacttaaacgatctcaatagtgctaaatatgtggttgatacggcattaaaactcacagggaacaattccgatgcggtgtatcgggttgtgaccattatcgaacccattgacgacagctttatttctgcttttctaccaaagaacttcgacaagtctgtgatagaagaagcgaataaagccttacatgcctttactcaagccaactttccagagggctcaaaggttcaacatattgtggctcacggcaccatctacgaagagatcaaccgcattgccgaagaaaaatccgttgatctgatcgtgatgttggcaagcagtaaacctaatgcaaaaggactgagttcaaatacggtaaaagtcgctcgaaatagcgacaaaccaattttagttctgcgttaggcaatcaatacaagcggtaggattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttatttttctgtcagctaaacataacgctatatcgaattaaaggaaatagccttattcaaaatttcaaatcaagcacttttccgttatacttttcattaatgagagtgactaaaggagccgattatgaccccatctcaacttattcaagctaaacacactgaaattatggcaatcagccggcaatttgcagtggagaatgtgcgcatatttggttcagtcgccaaagggaaagacacaaaaaatagtgatttagatattttggtagataccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttggtagataccacacctaaaacgacaatgtttgatctatgtggtttacaaatggagttggaagatttgctaggtataaaagttgatgtacttaccccacgcagtttacctgaaaaatttcgtgagcaagtattagcagaggcaaaattattatgaggctagattttgtagtagtctatgaaacggctattacatctgtgcctgaattattaactcaaattgaagcattaatattggagacacaaaataagcgctagaattttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttattttttcgatctgcgtcgaaaaatgaaaaatatcaacttttcttcttatacctgctttctataatgccttttcatttatctcaagggcagatttatgttacatctagaaagctatcaaaattggttaaaatcacttaaatatcacattcaccactcccagcaacgagctatgcttgcggtaaacagcgaaatggttttgctttattggaaaatcggacaagaaattttacagcggcagcaaagcgaagggtggggagcaaaagtcatcgatcaactttcacgagatctcactgcagaatttccagatatgaaaggcttttccagtcgaaacctaaaatatatgcgaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcatcaaattgctttactagataagctgagtgatgaacaggaacgcctttggtatgctcgcaaagcaattgaaaatggctggtctagaaatatgctggtacatcaaattgaaagtcagctattttaccgtcagggtatagccatcacgaattttgacaaaaccctgccagatacacagtctgatctagcaaggcaagcctttaaagatccctatattttcgactttttaaatttaacggaacaacgccacgaacgtgaattagaacaggctttaaccaaacatattacacaatttctattagagcttggtgctggatttagttttgtaggaagccaagttaagttaaatgttgggggtgatgatttctatattgatttactgttttatcacttaaaattacgctgttatgttgttattgagctgaaaacctgcgattttaaacccgagcatatcggacaacttaatttctatttgactgtcgtcgataaccaactaaaaacagagatagatacgccgacgattggactattgttgtgtaaaaatcgcaataaagttgttgtggaatatgctttacaaaataatccattacccattggcgttgcagaatatcaacttcagcaactgttggctgaatttgatatggaataatcctacttcagttctgcgttaggcaatcaatacaaacggtgaggttttgaggtatttttgtaatttgcaaaatatttgccgaatctcatcgttttgaattaatcagacagacacatcattttaaacgagtctgtctgattaggtttgctcttctacagataaagtatatcaattttagtttctatatgctttatccattgccataatcacttctcgcacgacctttttttgttcttttggtaagtttaggaacattttaattaccgtttgatcttgatagcttgtggcttcttcccaaagatgcttacttggctctttttctactctatctaatttataagctaattcttccgataccaaatctgtcacaggtacatttagccattccgctaatgttttaagtctggcggatcttggtaatgtttcacctcgtagccaactggcgaaagcatgtaagccaatcggtttgccgtaatgtcgtaaattaaattcacgttctaataccgaagccataggtttataccctctttcaattaagagagcttttagtttttctgcaaaaagttttttctcgtccatgttgctaagttaatttttaacttaatttttaacgaaagattgatcaaaacttacgtagatattatgatacttacgtttttacttacgttaataattaacttgaaaattacgttctattatgacaatccaaatcaaatccaaacaacgtgtttccgatcacggtgaagtatttactcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagaaaaaaacactcagtgatgacgaaaagaaagagaaaagtttacgaaaacaagtacaagaaaaattaatcaagtttgctacacgcattccgatttttatgtacttaaccgacaaccgcgaatacagcttaaaagatgtcatcacacaacttgaacctgaacttttctataaagtaacaggcttaacgcaaaaggactttagcttattggtcagtttaaatttatttaatagcggacaaatgaatgatgctgtgtataaatttaagcgttatgaagatgccagtttgacctattcaggcttaattaaacatcaagaaagccgaattggtttatatgacaccacaattagtattcaagagtacagaatggattaaggggttcttctttatttcattgatacaatatcggatttttctattaaaaatgctagaaaatagcctgtatactgaaacatacaggctgattacaaaatttaaggcatagcaaaaaatcactgctatgcctaaattttgtaaataatttgctcaatcccaccgcttacccttcaaagggattaaacaacttcacacctgtgcgagcaaaatcagcggaatttcgagtgactagcgttaagttatgttgaattgcactggcggctatccacgcatcattttcgggggcgtgatcagggatatgtaatttggcacagatttgggcagttttttcgtctattttcaggattttgccatcaaaagcaggtttgatctcaaattcaaaccagtggcgtaacatttcaccttgcagtgtatccttatgctcgattgccatcacaccacgttctaattccatcatcacaactgcattagtaaacatcaattcttttgatgttgtcattacccactgtgccaccccttgattacatttacctttaggtaattttctaatttcactgattaaattagtatctaataaatacattttttcccctactcagtaaaatctacaggacgacgttgagctttgctgcgaggttgcaactcaaattcaatatccgctacattaggattacttgggcaaagtgcatctgcaatactcacaaacggcttcgcttgctgtactttttcatattcccgatatgtcattaacacaaatgcaggtgtaccacgattggtaatgatcacaggttctagcatagcggctttttgagcttggctaggacgttgattaaattcacggctggttataactggcattttgtactctttcaatgtagttaagtagccacaatcttactgcgattgacgaaatagggcaagcgtaaaaagtggaatatgatttataccgttcaattactcttattttgtttcagcgttgaaaccatttttacgctacaataatgccattcaacaaaatgacttttgattatcaacaatgaaaaaactcaacattatttttgcaggcacacctgattttgccgcaacccatttacaagccttgttaaattcggaacataacgttattgctgtttatacacagccagataagcctgctgggcgtgggaaaaagctacaagctagtccagtcaaacagttggcggaagcgcaccatattcctgtgtatcaaccgaaatcgttacgcaaagaagaggctcaggcagagttacaggcgttaaacgctgatgtgatggttgtggtggcttatggcttaattctgccagaagcggtgttaaaagcgccgaaatatggttgcttaaatgttcacggctcgttgttacctcgttggcgtggggctgcgcctattcagcgttctatttgggctggtgatacggaaacgggtgtgaccattatgcagatggatattggcttagatacaggcgatatgttgcataaggtgacaacgccgattttagcgacggaaacgtctgccagcctttatgccaaacttgccgaacttgcaccacccgcattgcttgaagtattaaacggtttaacaagcggtcagtttaagcctgaaaaacagcaagacgagcaagcgaactatgccgaaaaacttacgaaagaagaagcaaaattagattggaatatgaccgcttgtcagcttgaacgtaatatccgagccttcaatcctaccccgatggcatatttgaccttgatggtgaatgaggtggaggagcggataaaagtgtatcaagcggaagtgctaccacatcaagagaaagcggtcggcacggtgttggcggtggataaaaacggtatccaaattgccacgcaacaaggtgtgttaaacattacccaacttcagccagcaggtaaaaaaccgatgtccgtacaagattttttaaacggacggggggattggtttaaggtaggaagcgttctctaatgaaaaaacattccactcgtgccgttacggcacagattattttacaggtgttggatcagggcaaatccctttcaaccttgatccccgaagcacaatcgcaacttgatagtaaagatttagcgtgggtacaggaaacgacctttggtatttgccgtgtgttgcctcgtttagaagcgattatcaaattgttggtagaaagaccgctgaaaaacaaaactcgcttggtgcattgtttgcttttggttggcttatatcagctactttatatgcgagtaccaccacacgctgcggtagatgaagtggttaatgcgacaaaagtgttaaagttagatagctttcgagccttgactaacggagtacttcgccgttttctgcgtgagcaagaagcaattttggcgaaagtggataaacattggcaaacactacaccctgaatggttggtgaataagctgaaacaagcctatccgaattggcgagagattgttgatgcaaataaccaaaaaccgccgatgtggattagggtgaatactcaacggactaaccgagcggactatgtggcattgttgggtgatcttgcaaaaaatcacaaagaagcgaccgcttgcatgcctgattgtgccgttttattagataaagcggtgtcggtcagccagcttcctcactttgagcaaggttgggtaacggtgcaagatgtacacgcacaatggtctgccgaattacttgatgcacaaaatggcgaattgattttagatgcctgtgcggcaccggggggcaagacaacccatattttagaaaaagcaccgcaagcaaaagtaattgcattagatattgaagaagcccgtttagttcgggttaaagaaaatttagctcgtttaaaccaaacggcaacggtgatttgcggtgatgccagccagcctgaacagtggcttacaagcggtgagatgttcgataaaattttacttgatgccccttgttctgcaacgggggtaatccgtcgtcacccagatattaaatggctacgcaaagaagaagatattgctgagttggcagaattgcagggaaaaattctcaaagcactttgggcaaggctcaagccaaacggtgtgttgctgtatgctacttgttctgtgttaccagaagaaaacagtcagcaaattcagcactttttagctcaaaccccagaggctaaattagtcgaaatcaatgtgggtggcgagcaatgtttaatgaagcaattctttcctaaacaagatgggggagatggatttttctatgcgaagttagtgaaacaggcgtaaaacggtgagtaggcaatgaaaatcatcattttaggtgcagggcaagttggctcaacactggcagaaaatttagcgaataatgataatgacatcaccattattgatgatgatcagcaacgtttagctcaattgcaagataagcacgatttacaagttattcgtggtaatggggcttcacctcgtattttacgagaggcgggagcaagtgatgcggatttattggttgcggtaacaaataatgatgaaagcaatatgattgcttgtcagattgcatatacgctctttaatgtaccaactaaaattgcccgtattcgtaattcggattatgtccgtgagcgtgataccttatttaataacgccgtattgcctatcgatcatatcattgcacctgaattattagttacacaggatattttacgccttattgattacccaggtaccttgcagattgcccactttgccgatgaattaattagtttggtgagtttaaaggcgtattatggcggtccgttagttggttatcctatttcggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggttatcctatttcggcattaggcgatcatttacctcatgttgaagcccgaattgtgtcaatcttccgtcaagaaaaagcctttattcctcaaggttcaacgattatcgaagctggtgatgaaatcttttttgtctgtgctacgcaacatatcaaagcggtaatggcagaattacaaaggctggaaaaaccacataagcgagtaatgattgtggggggcggaagcattggaattgcacttgctaaagcacttgaggatcgttgcagtgttaaactgattgaacgaaaccaagaaagagccgaaaaacttgcttctaagctgtctaagactttggtgttatgtggcgatgcgtccgatcaagagctgttatttgaagaacatattgagaacattgatttattccttgctttgacgagcgatgatgaggcgaacattatgtcgtctttgttagcaaaacggttaggagcaaaaaaagcgatcgttttagtgcaacgaatggcatacctacaccttattcaaggcggaactattgatattgctctttcgccacaacaagcgacaatttccgctttgtcaagccacgtccgcaaaggcgatattgttcatgtggcttcgtttaaacaaggtttaatggaaggcattgaagtgattgctcacggcgataaagaaagctcaaaagtggttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcaaaatcagcgagctaaaactgccacagggagcaattgtgggggcgattatgcgaaatcgtgaagtgctgattgcccataaatctacggtgattgaggaaaacgatcacattattctgtttgtgaatgataagaaacagtctgccgaagtggaaaaactcttccagttgagtgcgtttttcttgtaataagtaaggagtaatagaactagtattaacttacctatattgtatctaatacaaaatctatttcgcctctctttctagctgagatgtaagtcacaaataacgggcaaatcttcaaaataaaatagttctatgctcgcttccattttatatgctatgttcgtgtaaataacaatggataaaaataattttatacgtcatataaactccactacatatgtgtttaacaacacattctacttatcttatcaatctaaaattaaaataagtactgattttgaatgaaagagtaaatcaaatttaattattggatttctcttttaaccaccattacttagtttttatattgctaagtttgaattattagacttgatttatatcctgtcattattactatttaagaaagttaaattatcaaagtccgaatattcaagtagccaaagtttattttcggtaatttctgacgaaataaataaaaagcatcatattcggaaacgctaaaggaaaactatgcaaagcgtaaaatccgtaagataaaatggtcacaaggagagattactggtaggtacaaaatactaattgtgcataaccataatgagtaaagaaaacgataatattattctgtttataaatgataaaaagcaatctacagaaagagagggaacctcctgtcaaagatggttttatggttctacaaacggatatatcaagatatcttttttcaaaaaatgtgattgtgatcacagaattactttataagcctttaatataatatagacgaaacaggatatttaatagtatatctgatacataaatgcaaccgctgaacgatatattattaataactatttcaatcaactatttataatatattcattacatcttaaaggagaaaactatgattcttggctgcccaaaagaagtgaaagtccaagagtatcgtgttggcttaacccctgcaaatgtgcaatcttatgttgaagcagggcatactgtttatattgaacacggtgcaggtgctgaaattggtttccctgatgaagcgtatcaagccgcaggtgcaactttgactgacaaagcaacactctttgcaaaaagtgatatgatcatcaaagtgaaagagccgattgaatgtgaatatcactacttccgcgaaaatcaaatcctttatacctacctacacttagccgcagacaaaccgcttaccgaaatgttgcttgaacgcaaaattcaatctgtggcgtatgaaaccatcaaaacccctacaggtttaccttgcttagcaccgatgagtgccattgcaggacgtttggcgaccttagaagctgcgaaatatatccaaaaaaccttcggtggtgcaggtgtgttactcagcggtacagcgggtacaccaaaagcgaaagtggtgattttaggtggcggtgttgtaggcttaaatgcggctcaaattgcgatgggtatcggggctgatgtcactatcctagatattaacgctgctcgtcttgcttatatcgatcaaatctttgatatgcgtatcaaaacactcaccagctctcgtggcaatattttaagcctattaccagaagctgacgtagtgatcggtgcggtattaattccaggtgctaaagctccacacttactacgtcgtgaagacctcaaattgatgaaaaaaggtgcagtattagtggacgtagcaattgaccaaggcggttgctttgaaacttctcatccaaccacacacaatgaacctatctatgaagttgatggcgtaatccactactgtgtggcaaatatgccaggctgtgtggctcgtacttcaaccttaggtttaaccgactcaaccttagaatttggcttgaaactcgcagcactcggtgtgaaagaagcgtgcttgtctgatccagccttattacaaggtcttaatacttataacggtaaatgtacattcaaaggtgtcagtgatgcctttggtattgcttataccgatccaaaagatgcattaaattaatatcaagctgtgttgtattgatcaagaacattccccctgaataatcagggggatctctcctatccaccatttagggttttccctaaatcaatctcaaattagcggttgtgttagcttgactgagcctactctctgctatttttaaaagaggtatactatgagtgaaaatacaaaacctgaacggcagtcttggtctagtcaattaacctatattttaactgtcgcaggggcgacagtcggtttcggtgcgacttggcgtttcccttatcttgtaggggaaaacggcggtggtgcttatgttttccttttctgtattgcgatgattgtaatcggtattccgatgattttagttgaaaatgtgatcggtcgtcgtatgcaagtcaattccattgatgccttcggtggcagtgcgaatggcaaaaaaatccattctgcgtggaaaattctcggctatatggggctactgggttctgtcggtatcttagcctactatatggtattaggcggttgggtactcacctatatcggtagtttagcaacaggcggcttagatctctcttcgccagtcacaattgaaaccacatctgcctactttaaagataacattcaaaacaatccattaagagttattctttatacgggcgtttttgttgcggtaaactactttatcctaattagaggtattaaaaaggggatcgagcgttctgttaaattactgatgccactactctttgtcttcttaatcattatgattattcgtaatgtcaccttacctggtgcggccgaaggtatcagcttctatcttgttcctgatttttcaaaaatcacaccgaagctatttgtcttcgtattagggcaggtattctttgcacttagtcttggttttggggtattaatcaccttatcaagctacttgtctaaacaagaaaatctagtcaaaactgcaacaattacaggggttatcaacaccttaatcgcccttgctgctggctttatgattttcccatcgctctttacctttaatgttgccccgaactctggtccaacattggtattccaaagcctaccgatagtgttctcacatatgtgggcaggtacaatctttgcgattatcttctttggtttattaatcactgcggcacttacgacatcaattaccatctatgaagtattgattaccgcattgcaagaaaaaaccaaactgagccgtaaacaagcgatcaccttgacgttatttggtatctttatcgtgggtaatattccatcagtacttggcgataacgtttggagcaatgtcaaaattgcaggtatgagcatttttgatgctttcgactacataagcggtaacattctctttgttttaaccgcactaggcagtgcgattttcgtcggctatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgaaagatgaagcgaagaaagagttaaacaccagtgaaaaattcacaaacatttggtttagctacgtccgttatgttattcctgtactgattattgtgatttttgttaattcgctttaattaggtaatatgaaagcggtgagaaagttgtaaaaaatacaatattctcaccgcttctgtttagtgggtataatagtaaataaaatctaataaaggaggatactactaatctcttaatctatccaaaagctcgggctgagaataaccaacaaggtaaacacttccaaacgcccacaaaccattgcaaacgttaatacccattttgcactgtcgggaatttgagtaaagttactactgaccgtgcctaatgctggtccaaggttattcaaacttgcaatcaccgcatttaatgcatcgaaagtttccataccacaagcaatagtcgccaaccaacagaccacaaatacaaagaaataggctgaaaagaatgcccataccccttccacaatccgctctgataaaacgtgtttaccaagtttaatcggctgaataacatttgggtgaataaagcggtggatttctcgttttccttgcaaataaagcaacaacacacggaacatttttaaaccgccgcccgttgaacctgcacaaccgccgataaaagaagcaagcactaataacaacggcaaaaaagagggccactggctaaaatcgttggtggtaaaacctgccgtagtcgaaatagatactgactggaacaaggcttgaataaaagtgacggagtgatcgtcaaaatagttataaatcaacaacaccaataaaaaagcgaaattcgtaatctttccaatacaaaccaagaaaattcgacttattattgcctttgtagcgatcattaaactgatcaaacaccgcaaaatgcagagcgaagttacaggaagagatcaataagaacagcaccgtaatcaagtcaatcatcgggctgttaaagtagccgatactcgcatcgtgggttgaaaatccgccaattgccaccgtggcaaaactatgggaaattgcatcaaaaccgttcatacctgccaaccagtaagcaactgcacacagcactgtcaaagagagataaatcagccacaatgcttttgccgtttctgcaatccgtggacgcattttctgctctttcaacgggccaggcatttccgcacggtataactgcattcccccaatgcctaataacggaataatggctaccgcaagcacgatgatccccattccgccgagccattgtaggaactgacgataaaataaaatcgcttttggcagctgatctagccctgtaattaccgttgcccctgttgttgttaaacctgaaaaagactcaaaaatagactcagagaaattcaaatcagggttttccaacagaataaatggcaccgcccccagcgaccctagcaccacccaaaacagcaccacgattagaaaaccttcacgggaacgtagctcttgcttatattttcgacaaaaccaccacaaagccgtgccgacactgaaattcagcacaaaggcctccaaaaacgcacgaccgccgccgtcatcataaatcaacgctacaaacgctggcacaagcatcgtgaaagaaaaacacatcaccaaaatgccaacaatacgcataattgaaaaaaattgcacagggaaatcctttaaataataagataatgaaatggtactctgcttttcgcacgagtcaaatcatttgaaaaccaagatcttggtttataagcggtgagataagtattgttttttacaaagaataaattttactctgtctttgttctaatttttcaatgaccaaattggtttcaccatattcaatttaggcatactcatttgtttacatcactaattttttcgccatatcttctttcaaccattgattaatttctctcatctctcgaattttatcgtgaatttccattgccgttctaaacaatgctggtttatctgcactgactaagccaaataatacggatgagatagttactgtacttaatagcgtaacaatagaaacactatttgccgccaactttccaaacgtttcaaagcgaactgcatatgcttataacgaaaatgtaaatgatgctctaattttacaaaataagatttgttcaatttcacgctcttgaattacatattttatctagctgaaataattgtctaagatattgagctactgcctcatctttattttcaccaatttgctcattatttggtaaagcctgttttaaacgaggatctgcattacccattagacagccttttcctgcttgggatagcatttcaatatcattcattccatcgccaaaagcaatacaatctttcaaggtatagcctcgtaacttgactaagtctgcaagtgtatttgctttacaaacgcctttattcatcatttcaaggcattgaggggtagaataagtaatttgtagtaaatcaccataatgatgtcgcacaaattgctcgacaggtaacaagtcttcaggcgtttttccaataaagaacactttttcagtttttttaccgtgatgttgctgaaaatctaccacttgatacataaagccagagtcttggtgatattttcgtaattgttcgatttcaatattaatgaaccattcatcgtcttgatagctattaatgaagactcgcttaggatcaaagggtgtttcgctcattatcttaaaagcaatctcttcaggaatgtggttttgataaagcaactcaccagaaaggctattccctctcgcaccattagatgtaactagcattgcatcactcacgccaactgtactaataatatgtttaacatcagggtaatttctgcctgtagctagaaaaatatcgacaccacgttgtgaaagtttgtgtaatgtttcgatagtaaaatcgccaatgcggtgatttgcattaagtaatgtgccatcaagatcagaaataattgcacgaaaaggtaaggtcatagaaattcctttatcattttgaaatggtagtttaagcctaacaaatttattttatcatcgcaaaagaaagcattcattttttgtttgtgattaagctacggttaaaaaatagcaaaataatataaaaaatactaaacatcattttttgctgaaaaaaaatgatatttatgcgttatacattacaggggtttatattaatcactagttagtctaaattttttagcatatttaactattttaattacctaaaaatacacagaaaacgtttgcgccaagtataaaatgctattgacattactccatttgaagttaatatatgttcaatttctgaataacaatgcaaacataaacacacaactatggtaaaacttttaactcttaacctgctgggattcacgcattctgtgcgaggataaggctcggttagagaaaagttcactatccacacttagcccgcacgtcaaaatgcgggctttttttatcgaatacattttaagaggtactttatatgagcaacaacattattatttttgataccactttgcgtgatggcgaacaatcattaaaagcaagtttaacggtaaaagaaaaactgcaaatcgcacttgctcttgaacgtttaggagtagatgtaatggaagttggtttccctgtgtcatctgctggcgattttgaatcggttcaaaccattgctcgccatattaaaaatagtcgagtatgtgctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcagcagaagccttaaaggttgctgaagcatttcgtattcatacatttatagccacttccgctttgcacgttgagtctaaacttcgtaaaacctttgacgatgtattagatatggcagttcacgctgtaaaacgagcaagaggctataccgatgatgtagaattttcttgcgaggatgcaggacgcacaggggtagataatatctgccgtattgttgaagctgcgatcaaagcaggggcaaccacagtcaatattcctgatactgtaggttactgcttaccaatggaatacggaaacatcattgctaatgtgatgaaccgtgtaccaaatgtggataaagcggtgatttctgtccattgccataacgatttaggaatggcaactgcaaactcattaaccgcaattcaaaacggtgcaagacagattgagtgtactatcaacggtatcggtgaacgtgcaggtaacacagcacttgaagaagtggtaatggcaattaaaacccgccaagccttatttaacggcttagatactcgtatcaatactcaagaaattcaccgtgtcagccaaatggtcagccaactttgtaatatgccaattcaaccgaataaagcgattgtggggtcaaacgcatttgctcactcatcaggtatccaccaagacggtatggtcaaaaataaaaatacctatgaaattatgtcgccagaaactatcggtttgaaaaaagagaagctcaatctgaccgctcgttctggtcgcgctgccgtgaaaaaccatatggaagagatgggctatccagagagcgattacgatttagacaaactttatgaagctttcttaaaactagcggataaaaaaggtcaagtttttgattatgatttggaagcacttgcatttattgatatgcaacaaggcgatgaagatcgtttagcccttgatgtatttaccacacaaattattagtggtttgccagcttcagcctttgtgcaagttgagttagatggtaaacgtgtaagccaagtttcacaaggtggtaacggtcctgttgatgcggtttataatgctattttagcgattacaggtatggaaattaaaatgctcaactataacttaaccgctaaaggcgaaggtgctgaagcattaggacaggttgatattgtcgtagaatatcaaggtcgccgtttccacggagttggtttagcgaccgatattgtagaatcttcagcaagagctttaatccacgcaatcaatgcgatttatcgttcacagaaagtggcggatttgaaggggaaaataaatagtcattttcttaaaaattagcttaagtttatctgtggttgagttaaaatttcgtgatataaaaattttaatatattactgtcattgtataagggaggtcatttttgtttctacttaagaaaaaactttttgaacgcctattgcgttacgttcaaatccacaccacatcagatccgaaaagccaaactgtccctagctcaccgcaacagtgggatttacttcatctactcaaaactgaaatggaaacgatgggattaaccgagatttccgttgatcctaacggctatgtgtttgcaacattgcctgccaatagcgacaaagccattcccgtactcggtttactggctcacgttgatacctcccctgatttcaacggcgagaatgtgaagccacaggttattgagcggtatcaaggcggtgatattttgctaaaaggcagtgggcatacgctatcgccacaggatttcccgaacctaaacggcttagtcggacatacgctcgtgaccaccgacggcacaactttgcttggtgcagatgataaatctgggattgcgattattctgtcagcggtagaatacttgttagcacaccctgaaatcaaacacggtaagatccgtatcggttttactaccgacgaagaaatcgggcgtggagcggatcattttgatgtcaaagcctttggagcagatgttgcctataccttagacggcggaccgcttggggaattacagtacgaaaactttaatgctgatgcggcaactgttacgttctacggacgcagtgttcacccaggcacagccaaaggcaagatgatcaatgccttagagcgagcttgtgagttccaaaacagcctaccgccacatttaacccctgcaaccagcgaagggcgtgaaggctttattatgttgcacgacattgaaggcgatttaagcgaatgtaaaatccactatattttacgcagttttgagcgtgaagaattagcaaaattcggcacttatctcaccgctacaatggcacaaatgcaacaaaaatatggcgaacagtgcggcaaagtcgagattgtcgagcaatatcgcaatatgtacgaagtggtcaaagattatcgctatctggtggatattgctgaaaatgtgatgaaagcacagggtattacgccaaacctagagccaattcgtggcggtaccgatggctcacgcctgtcatatatgggcttaccaacgccaaatatttttacaggcggcgaaaacttccacggacgtttcgagtttatttctgttgatgtaatggaacaggcgacaaatgtggtggtggggattgcaaaagcctttgggggatatccgtttaaatcattatagatattcttataattaaaattatttgtagtaaggatagttacgaataagttatatcttgatcatcatagacctaaaattgaataggcgctaacattgtgcctttcctaaagtaattttttctttatctactaaatatcaaattaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttatttgtactgtttgcaaccttgactatttatttcgctgttttcaggtcttgataatatttctcataaagttcaatcgcatcgcctacatcaacttgccaagggcttttctcaatcacttcgggacgaataaaaacagcaggatcgtcaaccaaatcttttggtaactgtgctaatgccactttatttgctgttggataaccgatagcttttgtcaattttgcagcgacgggagctgaaagcatatagttaatcagcttgtaagctccttccggattttgcgaagttgcaggaattgccaagttatcaatccaaagcggtgtgccttctttaggataaaccatattgattttagcaccttcatttttggcaattcgtacagaaccattccaaagagtaccgatttctacttcaccagaaataaatgagcttgagggattgtcagaattaaacgccaaaatatttggacgtaatttcaaaaattcttcatacgctgcttttaaaatcgcagggtcttgggtattcggatcctgccccatttttaataacgctatattaaatgcctcacgaggatcatctaacaactgtaatgtatctttaaactctggtttccataaatctgcccaagattgaaaatttgcaggatcttgggtttccgtattgtatgcaatccccgttgccccaaaaagttgtggtaccgagtatttattgcctttatcaaaaggacgatcaagcatttgtgggtcaagctcacttaatacaggcaatttgctatgatctaactctttcaacattccttcacgtgccattttagaaacaaaatagctggtgggggcaattacatcataactttgatggtacatattcagaccatgtatagagataaaccgtattcccttccttcgccatgatgtgatgactaccaaaggtaagagttgccgcagataaaaccactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactaaagccatataaaaacttacctaaagatggctatgattttaggttaattgaagctgattgcaacatcttcagtaagatgctgctattctggacttcttatacctactttgcatataatccctcatcatgtaagtataagaaaaaggacgctcgaaagcgtccttatttatctattctttaaaattaaagagcagattttgctttagcaactaatgctgcgaaagccactttgtcaaatactgcgatatcagcaaggatcttacgatcgatttcaacagacgcttttttcaagccattgatgaatttgctgtatgataaaccgttttgacgagctgccgcgttgatacgtgcaatccataattgacggaattgacgtttacgttgacgacggtcacggtaagcatattgtgcagctttaactactgcttggaaagcaacgcgatacacgcgtgaacgtgcaccataataacctttagcagccttaagaactttcttatggcgtgctcttgcaataacaccacgttttacacgagccattattaaatctcctactatttaagcgtaaattaacgctttgacattattaaactaaaaattaactaatcgtacgttgtacttaatttacgcttatgcgtatggtaagcacgctactactaaaacttggtctgctttcgctaccattgatttgtgacgtaagtgacgtttacgtttagttgttttcttagtcaaaatgtgacgtaagtgagattgtttacgtttgaaaccgccagaagccgtttttttgaaacgcttcgcagcaccacgtactgttttaattttaggcattgttaaaataactccgcattgtttatgaataaccagtaattaggcgaatattgttgccaatattacttggaagcactaattacatctcaaggtaatggactatttctttttaggcgctagtaccattacaacttggcgaccttcgagtttgcctggggcagactctactacggcaatttccgctaaatcgtttttaacacgttctagcacgtccataccaatttcttggtgagccatttcacgtccacggaagcgaaccgtgattttggctttgtcgccatcttccaaaaagcgaatcaggctgcgtagttttacctgatagtcgccttcgtctgtacctggacggaatttaatttccttcacttgtacaactttctgttttttcttctgctcttttgcagctttctctttctcgtagatgaacttaccgtagttcataatacggcaaactggtggttcagcatttgggctaatttcaactaagtctaactcagcttcgtcagctttcgctaatgcttcttgaattgatacgataccaagttggtcgccgttttgatcggttaagcgaacttctttcacgcggatttcttcgttaagacgatgtgcgcgatttgtctgaacacgttttacaggtttaatagtactattcctctagtaagtttaagctacgatcataccgcttgcagaagatatgatttctttttataggctcttctaaagagagcaaaacgggcgagattttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttataggctcttctaaagagagcaaaacgggcgagattttacagaaattcgcctgattatgcaacagacaaaatcatttcattacattctcagcaaaattgttgatattccattataataagcactatcttaattacttaaattaataacaataatgaaaattctcggtattgaaacttcttgcgatgaaactggtgtggcaatttatgatgaagacaagggattagtcgcaaaccaactttacagccaaattgaaatgcacgctgactacggtggcgttgtgccagagctggcctctcgtgatcatatccgtaaaacattgccactcattcaagaagcattaaaagaagctaatctcaccgcttctgacattgatggcgttgcttatacggcaggcccagggcttgttggggcgttattggttggctcaaccattgcacgatctttagcttatgcgtggaatgtgccagctttaggcgttcaccatatggaagggcatttgctcgcaccaatgttagaagaaaacgcccctgagtttccttttgtcgccttacttgtttcggggggacacactcagctagtcgatgtaaaaaatgtgggtgaatatgaattattgggggaatctattgatgatgctgcgggggaagcctttgataaaactgcaaaattgctcggtttagattacccagggggggcagcgttagctaaacttgctgaaattggcacgccaaatcgttttacctttccacgtccaatgacggaccgcccaggcttagatttcagcttttcgggcttgaaaacctttgcggcaaatacgattaatgcgaatttgaatgagaaaggcgaattagatcaacagacccgttgtgatattgcctatgcgttccaacaagcagtgattgaaacgctgattatcaaatgccgtagagcgttgcaacaaacgggctataaacgtttagtgatcgcgggcggtgtgagtgcaaataaacaacttcgtcacgatttatccgaattaatgaagcagatcggcggtgaagtcttttaccctcgcccacaattttgtaccgataatggtgcaatgattgcctatgcaggtttcttgcgtttaaaaaatggcgaacagacggatttatccgtgagtgtcaaaccacgttggccgatggttgaactttgtcccatcgatgtatagtagacaaagtattataaagggtagattaagatattgtaatataaggctttgagccacttttttgaattatcaggactattcaaagtatctcgaaagcccctaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaccttctttgatcgtgaacttggtattttagtcctgatggatttactttctaaaaaaatggtttgccattgagttatcaaaacataaaaagatgtttattacaggatagcgttcaattttgtctattatgcctttattgattcgctctagaaaaagccgccgcttccgcgattaatgcatcacttggacgaatccccgtataaagcacaaattgctcaaccgcttgtaaagtcatcacttctgcaccagaaatcacctgtttgccttgagctttcgcatactgaatcaaaggcgtttctgctggcattgctactacgtcaaaagccgtttgagcctgttgaatcatcatttcagggaaagctaagtcaaattcttcttttccgcccgtcataccaatgggggtgacattgactaaaatatccgctggttgattttcaaggctattgatatattgatagccgtaaagtccagcaagatattttcctgtttcttgattacgggcatagatttttacattcgtaaaacctgaatgtttaaatgcggcaacaacggcttttgccataccgccgctgccttggacaatcacacaagcggttggatcgagctgatattttgcaattaatttctcaatcgcaatatagtcggtgttataggctttcaaatagccattggtattgacaatcgtattgaccgattcaatcgcttttgcagatgcatcaatttcgtctaaaaatggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaggcttctttaaacggcatagacaccgcacagccccgaatacctaaggctctcacgcccttaacagcgtgttcaatatctttggtggtaaatgctttataaacaaagtttaaaccgagtttttgataaagatagttatggaaataagtgccagtgttgcctggtctgcccgatatcgacatacaaagttgagtatctttattgatcataaatttgccttattgaatagaataagtaccattatgctgttttagatgtaaaacaacaaggaagtcatgaaaaaacaaaagccttgggtttccccaaggctttctttttgcatcaacgcataagcgaaaattattcgccaagacgctctttgatacgtgcagatttacctgaacgctcacgtaagtagtaaagtttagctttacgtaccgcacctttacgtttaacagcaatgctgtcaattacaggtgagtgagtttggaatacacgctcaacgcctacgccgtttgacactttacgtagtgtgaatgctgagtgcaagccacggttacgaattgcaataaccacgccttcgaacgcttgcaaacgttttttactaccttctactacccataccttaacttctaatgtgtcacctggacggaagctaggtacgttttgttttaactgttcttgttcgatttgtttgatgatgttactcattttaataaaccttctatgtcctagaattaactgatttgtgtcgtttctttatgttattcaacaacacgcgttgttcgtcagtcagagctaggctatccaatagctcagggcgtcttaaccacgttcgcttaagcgactgttctaatcgccatttgcgaatttgctcgtggtgacccgacatcagcactttcggtacaggtaagccatctaatacttcagggcgagtataatgcgggcaatccaataaaccttctgcgaaagagtcttccaacgctgaagtctgtttgcctaataccccagggataaatcgtgcaacagcgtcaattaacgtcattgcaggaagttccccccctgtgagaacgtaatcaccgattgaccattcttcatctatttcagtttggattaatcgctcgtcaatgccttcataacgcccacaaaccaaaatcaatttttgatttgtcgccagagtttgtacaccagcttgatcgagtttacgcccttgcggtgagagataaatcactttagcttctacaccgtcttccttacaagcggttgcttttgcttcacgaattgcatcacgaagcggttgcaccatcatcaacatacctggcccaccaccataagggcggtcgtctaccgttttatgtttgtcgtgtgtgaaatctcggggattccaacactgcacttgtaagagattttgttttactgctctacctgttaccccaaaatcagtaattgctttaaacatttcggggaaaagagaaataataccaatccacatattttgacctacgaaatgcgactgctaaagctcactgcatacctgaggttagaaaccagcgtcccaatccactgtaattgttttagtggcgagatctactcttttaactacttgttcatataagaacgggattaaacgttcttgcttaccgaaagcatctttactgccagcttttaccaccaacacatcatttgaacctgtttccatcatttcggtcacagttcccattgcataaccttcaaggtttagcacttggcaaccgatcaaatcgtgccaataataatccccttcttccaattctggaaacacggctaaatccacaccgatctcggcgttggttaatagctgtgcggtttcgcggtcttctgtgccttttaatttcacaatcaaatcattgttgtgataacgccaactttcgagttcaacttgttgccattgccctttaatttttaagaaccacggctgataatcgaaaatgctttcaggatattctgtcgatgaataaaggcgtagccagccacggataccataggttgaacctaattttccgacaacttcaattttttgctcgctcatactcacctacttatttaatttgtggaattaagctgctttacgcgcttctttcactaatactgcaacacgatcagaaagtgatgcgcctttagcaacccaagcatcaactttagcaacgtctaaacgtaaacgttctgcgttaccagttgcgatagggttgaagaaaccgatacgctcgatgaaacgaccgtcgcgtgggctacggctgtcagcgacaacgatttgatagaatgggcgttttttagctccgccacgagataaacgaatggttaccataaccgtcctctaaaagtttaatgatagtaaaaaagaaaaccctcgttcgaggtgagggtgcgaaacttgttcaaaaaagagagaacaagcggtcggattatacggattttttgcaaaaaggcaagtgaaaacccttgttttatgtttacaactctagaagaaaatgcaaaacaaaaacctattctcacgacaattattttcattctgtgataggaatgatggatatgaacttatcactttcaacctataataaagaattagatattttgaatcagtgtcgtaaataatcctatcttgttatcttaaacgttatttaaaaagtagcttagttataaaactaagctactttctcaaatactcaaccctcacatttaaactcgctaataaaatcgcaataagcggaattacataattcattacggcgtaaggggcatattcaaatgcactaacttgtagcatagagaatgcataaataccgcaagtattccacggcactaatacggaagtcactgtaccgccatcttcaattgcacgagatagattttttgaacttaagcctttttcacggtaagcatttgcgtacatccgtccaggaagcagaatagaaatatattgttcagcggcagtgcaattagtcaaaatagaggaaagaacagtagcaataataagatgggttgttttgtgggcaatacgaagaatagtttcaacaatggacttcagcattcccgttctctccgcaataccgccaaatgccattgcaataatggtcagtgagatggtgaaccccattgcttcaatgccccctcgattgaataatgagtcaatcattgcattgccactttctattttatagccataatgtagcgtgttcaccgcgacttttatctcgccaccttgtaccacaatatgacaaagccagccaaacaaaatcccgatagttaaagcggggagtgtaggcactttttttgcaactaaaacagcaacaacgagtggcacagttaatagccacggtgaaataacaaagtgcgttttaatggcttgcataatttcggcaattttttcgagttcgacactttgagcattgaactgtgaaccgagataagcataaacaagaagagcaataaggaacgctgggagggtagtgatatacatatagcgaatatgttcaaaaagcggcgtgtgcgtaatgcctgcggcgagattggtagtatctgaaagcggggacatcttatcgccaaaatacgcccccgaaatgaccgcacctgcaaccatcggagcggggatattgagacttagcccaatacccattgccgcaacaccgatagttcctattgtggaccacgaactgccaatcgcaagggtcactaccgcacaaataaggcaaattgtcgctaaaaatagagagggcgagatgagttgcaatccatagtagatcatcgtggcaacaatccctccaccaatccacgcacctatcgttaaaccaatcataatgatgataacgatagctggcagagaaatacgaatcccttgatatatcccttgttctatcgtatgccagcgatacccaaaacagcgagcaacgatagccgcgataattgtgctaatcagtaaaggaatatggggagatgattcaaattgaatgacagcaattcccattgataccatcatcacaatgataggtaaacaggcatagccaaatggaatgtgaatttgtggttcggttgtgtgtgacataacttcctcaaacaagcggtaagaaatacagagtaatttgcttttcggtagctttcactaataggaaattttcatcgaagcgatgagagattaatttacaaggggaaattcgacagagaggggagttgtggatttattcgggagctattctaacatatttgattaatatttcattatataaaataaaaaatacctgtatctcgttttagatacaggtattttttacatctcaacttaacgcttatttacgttgagttaccacttgaatgaacggagtttgtccttttttcatctgttcattcgcttgtttaaccatctcttctacattggtatgtaaatgagcggtaactttggtgtttgcttttttctctggaaccaagcgtgctttcactgtcttaccgtttacaacaaggttattttgttttgcattcacattaactggtgtgtttgtcgtttcacgtttaatgtctgcgtttaacttcacatcagctttcacacctgcaatagaaccgttattccagtcttgagctagattgttgttccatttttgttctgggtaaggagtatatttaccgctgccacttgctaaaaccgcacgacataaccgcaaccccaaaagcgagataatttcttattctcgctttttcatttaatgaaataatattacacttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaccccagccgtccacacctccccagtctaaatacaccgcactcagttgtttttacgcaaactaaacttgccatgcagggctaacagagtaatcctgtcgtcacttaagcaaaacaggagagcctaaaatgacaaccttcaaaatgagaactgagcaagaaatgatgttagagttagccttagttgcggtaagagaagaacaacgttttaccattgacggatcgcaatataccttaccaaatggacggggacaaacctttgtgtataaccttgcattcttagatattcgttttattgaagatggtcgcaaagatagcgttgtacaatttacctcaacccttgccccatcagcacctccgttttattgtttattatctgaattagattaaatttaaacgccctttaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaaaatattagcctgcttttgagataatattaaagaatattctcaaacttcgctaacatctctttcggccatacgcttgattgcacttcaccgatatgttttttacgcaataagaacattgccatacgagattgaccgataccgccaccgattgaaagtggtaaacgtcctgctaataaatctttgtgccagtccatttctaaacggtcttcgtcgcctgttaatgccacttgtaagcgtagtgcggtttcatcaacacggatacccattgatgataattcaaatgccgtaccaagttgttcgttccaaactaagatgtcgccgtttaagcctttatattcgccttccgataccgttgtccagtcgtcgtagtctggagcacgtccgtcgtgcgctttgccgtctgataatttgccaccgatgccgattaggaataccgctccgtattctttacaaatcgcattttcacgctctttgctggttaatgttgggtagcgtttcactaaatcttcgctgtgaacaaaggcaatctcttttggtaatagagacggaatatcaaaacgtgcttcaacggctaattcggttaaacgaactgcacggtagattgagcgaacagtctgttttagatagtcgaaattgcgttttcctgctgggatcactttttcccagtcccattgatccacataaacagagtgtgttggatcgagtgagtcttcatctgggcgtaacgctttcatatggacgaataagccttcgccttcttggaaaccaaaacgtgcaagggtgtggcgtttccatttagcgagtgagtgaactacttcataaactgcacctgggatacattttacgttcacttgtaccgctttttcgatacctgataagttatcctgtataccgttgcctacttcacttaaaattgggccttgtacttcaataatatctaactgttcgatgaggttttgggtaaaggtgttcttaacaaagctgatttcttgttgttgaagaataaatgatttttgcataataaatttccttttgaataaattctgtaagagatgtgcgtaatttaaattaattcttgataaacgcaacaacttacataaaaaaatcaaacaaagtcaatctatattagatattatctaataatttatgctatattttagttaatctctaacaaaagatagaaaaggaacagaaaatgcataaaaactatcaggcaacatcgcagattgacttactggatcaacaaattctgcaagttttaacccaagatgctcgagttccctatgctgaaatggcaaaaaattttggggtgagtgcagggacaattcacgttcgtgttgaaaaaatgcgtcaagcaggaattattgaaggcactaaagtacgcattaatccgcgtaaactgggctatgatgtctgctgttttattgggattattctaaaaagtgcgaaggattatgaaaaggtgattgcaaagttgcaggagtttgatgaagtggttgaagcctattacaccacgggggattactctatttttattaaagtgatgacccataccattcaagaattgcactatgttttagctactaaaattcagggcattgatgaaattcaatcaacagacaccctaatttcaatgcaaaacccaattttgagagaaattaaacctcaagcaaacgtttccagttgatcttgttcacatttttgaacattggtttgcaaaaaagatcgcaattctgatcgcttgattggtagaatgaagcggttagattactcgaatttttctcaaaaggagtcaattatgtcagaggtatttcatcttggcttaaccaaagcaatgttaaaaggggcaaaagttgctatcgttcctggcgatccagctcgtagtgagcgtattgcagcaaaaatggataatccagagtttttagcttcagctcgtgaatttacatcgtggttaggttatgtaggcggtcagccaattgtggtttgctcaacaggtattggcggaccatcggtttctatctgtgttgaagagcttgctcaattaggcgtgcgtactttcttgcgtattggtacaacaggggcaatccaaccgcatattaatgtaggtgatgtgttggtaacgacaggtgcagtacgtttagacggggcaagtcgccattttgcaccattagaatatcctgcggtggctgatttccgttgtacgaatgagctttatgcagctgcgaaaaatcaaggtatcgatccttatgttggtattaccgcatcatctgataccttctacccaggtcaagagcgttacgatacattcacaggcaaaatctaccgccatttccaaggttcattgaaacagtggcaagaattaaatgtgatgaactttgaaatggagtctgcgacactcttcactatgtgttctgcattaggcttacgttcaggaatggttgcaggtgtaatcgtaaaccgtactcaacaagagatcccaaacgaagcaaccattaaaggcacggaagatcgtgcggtttccgtggtggtagaagctgcgggtaaattggctcaagattataaataaaatgttgatgaggcagtgtgaatatctcagactgcctcagtttttataagggattcgggttagtctatctcttttcttgtttttatatcaataaaccattgatcttttcccaagttttagctttaatgcttgcccaattttgatttttctaaataaaagtgtaaatagaggcaattatggcagaaagttttagcgtaacacgtcgttttttcgacgataaaaattatcctcgtggtttctctcgtcacggtgattacaccattcgtgaatcgcaaaccttagagcaatttggtcaagcctgcttagcattagaaaacggtgaacgtgaacctgctacagcggaagaaaaacagttcgtagcggttgttaaaggtgaaaaagttacagaaactttcttagaaaaaacgtggcttaaataccgtgatttaaccagtaaaaccaaacgcatctacaccctttcaggcgatgtaagtggcgaccttggtggcgacgattcagcagaataatgtgtgggaaggcttgaaaaagccttttctttttctttcttgataaattcaaatgaccttaccaattcatcaatatccagcgttacttgcaaaaaaggcagagaatctcaccgctctacttgcaccttttaatgcacctgaacttgacgtttttgcctctgacacaagccattttcgcttgcgtgcagaatttcgtgtttggcatgataatggtgatctctatcacattatgttcgatcaggcgactaagcaacgctaccgtgtcgatcaatttccgattgcaagtcaactgattaatcgaatgatgacggtgttgctggctgaaattaaaggcaatgagctacttacacgtaagctgtttcagattgactatttaagtacattaagtgggcaaatcgccgtttcaatgctttatcataaatcgctgacagaagaatggatagagcaagcgaagttacttaaacaacgcttgatcggctatggttttgatgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgcttgatcggctatggttttgatgtccagttaatcgggcgtgcgacgaagcaaaaaattgcattagattgtgattatgtagaagaagccttgaatgttgatgggcaaatttaccgctatcgccaagtagaaaacagctttacgcagcccaatggcaaaatgaacatcaaaatgttggaatgggcgagagcttgtacggcaaatagtaagggtgatttattagaactctattgtggcaatggtaatttttcaattgcgttagcaaatcaatttcgtaaggtattagcgactgaaatttcaaaatcatcggtagaatctgcccaatataatattgcagtaaacggcgtagataacttgcaaattatccgaatgtctgcggaagaatttacggaagcgatgaatggcgttcgggtcttttaccgcttacgtggtattgatttgaaacaatatgattgcaataccatttttgttgatccgccacgagtagggcttgatcaagccacattagaaatggtgcagggctatgaaagaatcctctatatctcttgcaatccacatacgttagccgacaatttaaaacaattaactcaaactcaccgcattgaacgctgtgcattgttcgatcaattcccttacaccgagcatattgaaagtggggtttggttaattcgtaacagctaagtaggcgaaaaatagaacatttgacggttttgcatcattttgtgcttgacctagttcagagttatctatactattttacctgttttcagcggaggaatggcagagcggttgaatgcaccggtcttgaaaaccggcgagggttaacgccctccgtgagttcgaatctcacttcctccgccactgaatatacagcctgttgataagcaattatcagcaggttttcgctctaaagagcaaataaaaattaaaaatagctttcaactcggaggaatggcagagcggttgaatgcaccggtcttgaaaaccggcgagggttaatgccctccgtgagttcgaatctcacttcctccgccaactaaacatagaaaatatgaataatctaagctgaacgggattttcttagtttttagttacaatttattctcgctgtagatctcaaataatctttgggtaattatgttcatgagtcggtctacatcaggactattatcattattttcaagagtccttgctctaaatcagatatccaatattattaaataggtttgacttctattgagttctattttagaatgagttagtcctttcgtctgtgaaaggcttttttattgttttaatcttaactggagctttattaatggcaactatcaaccagctagtacgcaaaccgcgtgtgaaaaaggttgtaaaaagcaacgttcctgaattagaggcttgcccgcagaaacgtggtgtgtgtactcgtgtatacactacaactcctaaaaaaccaaactcagcgttacgtaaagtatgtcgtatccgcttaacaaacggttttgaagtaacttcttatatcggtggtgaaggtcacaaccttcaagagcacagtgttgtgttaatccgtggtggtcgtgttaaagacttactgggtgtgcgttatcacactgtacgtggtgcacttgactgtgcaggcgttaaagaccgtaaacaaggtcgttctaaatacggcgttaaacgtcctaagtcttaatggttctccgttaagtaaggccaaacgtctaattagtcaaactatttaaaccataaactccagtcaatgcgactttgtcgccatagagttttggataatcctgaagatttataatacggagaaattgcaatgccacgtcgtcgtagtattgaacctcgcaagattcttccagatccgaagttcggttcagaattacttgcaaaattcatcaacgttttaatggttgatggtaaaaaatctatcgcagaatcaatcgtttataatgcgttagaaacattagctcaacgctctggtaaagatgcgttagaagcattcgaaatcgcacttgaaaatgtgcgtccaacagttgaggttaaatctcgtcgtgttggtggttctacttaccaagtaccagtagaagttcgtccaactcgtcgtaatgcattagcaatgcgttggattgttgaagctgcgcgtaaacgtggcgataaatcaatggcaatgcgtttagctaacgaactttcagatgcagcagacaacaaaggttcagcagtgaaaaaacgtgaagatgttcaccgtatggctgaagctaacaaagcgtttgctcactatcgttggtaataagcttttgatgtttgtaggcttcatctcaaaatttgcgatgaagcctattactatataaacaaattcacattagattcccaaaaaggtaataataatggctcgtacaactcccattgagcgctatcgtaatatcggtatcagtgctcacatcgatgcaggtaaaacaactacctctgagcgtatccttttctatacaggtgtaagtcacaaaatcggtgaagtacacgatggtgcagcgacgatggactggatggaacaagaacaagagcgtggtatcacaatcacctcagctgcaacaacagcgttctggtctggtatgtcgcaacaatatccacaacaccgtatcaacgttatcgatactcctggacacgttgacttcacaatcgaagtagaacgttcaatgcgtgttcttgacggtgcggtaatggtttactgtgcagttggtggtgttcaaccacaatctgaaactgtatggcgtcaagctaacaaataccaagttccacgtattgcgttcgtaaacaaaatggaccgtactggtgcaaacttcctacgcgttgttgaacaaatcaaaactcgtttaggtggtaactctgttccgcttcaacttccaatcggtgctgaagaaaacttcaaaggcgtagttgaccttatcaaaatgaaagcgatcaactggaatgaagctgaccaaggtatgacgttcacttatgaagatgttccagcagaaatgcttgctgactgtgaagaatggcgtaacaaccttgtagaagcagcagcagaagcttcagaagagttaatggaaaaattcttcgcaggtgaagaattaactgaagaagaaattaaatctgcattacgtcaacgcgtactttcaggtgaaataatcccagtttgctgtggttctgcattcaaaaacaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgttcaagcaatgcttgatgcggtaatcgactacttaccagcaccaacagacattccagcaatcgaaggtatcaatgaagatggtacaccaggcgagcgtcacgcaagcgatgatgagccattctcttcattagcattcaaaattgcaactgacccattcgtaggtaacttaaccttcttccgtgtgtactcaggtgtaattaactctggtgatacagtttataactctgtaaaacaaaaacgtgagcgtttcggtcgtatcgtacaaatgcacgcaaacaaacgtgatgaaatcaaagaagttcgtgcaggcgacatcgctgcagcaatcggcttaaaagatgtgggtacaggtgatacattatgtgcgcaagaagcaccaatcattcttgagcgtatggaattcccagagccagtaatctctgttgcggtagaaccaaaaactaaagctgaccaagagaaaatgggcttagcattaggtcgtttagcacaagaagacccttcattccgtgttcacacagatgaagagtcaggcgaaaccatcatttcaggtatgggtgagttacacttagacatcatcgttgaccgtatgaaacgtgagttcaaggtggaagcaaacatcggtaaaccacaagtatcttaccgtgaaactatccgtactcgtgttaatgatgttgaaggtaaacatgcaaaacaatcaggtggtcgtggtcaatatggtcacattgttatcgacttatatccattagatccagaaggtccaggatacgagttcgtgaacgaaatcaaaggcggtgtaatccctggtgaatatatccctgcggttgataaaggtatccaagaacaacttaaatctggtccattagcgggctacccagtagtggatttaggtgtacgtttacacttcggttcataccacgatgttgactcatcagaattagcgttcaaattagcagcgtcattagcattcaaagcagcgttcgctaaagcaaacccagttctacttgagccaattatgaaagtggaggttgaaactccaccagattatgtgggggacgttatcggtgacttaagccgtcgtcgtgctatggtaaacggccaagaagcgaacgaattcgttgttaaaatcaatgctgaagttccactttcagagatgtttggttatgcaacagacttacgttcacaaactcaaggtcgtgcatcatactcaatggaaccgttaaaatatgctgaagctccaacaagcgttgcagcagcagttatcgaagcgcgtaaaaaataatttttaactttttaaaactccatagcacatagtgtgctatgggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcatcaacaaaggaaactttacaatggctaaagaacaatttaatcgtggcgataaagtccacgtaaacgtaggtacaatcggtcacgttgaccacggtaaaacaaccttaacagcagcaatcacaaccgttcttgcaaaaactttcggtggtgctgcgcgtgcgtttgatcaaatcgacaacgcaccagaagagaaagcgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaccagaagagaaagcgcgtggtattaccatcaatacttcacacgttgagtacaacacagaatcacgtcactatgcacacgttgactgcccaggacacgcggactatgttaaaaatatgattactggtgcggcacaaatggacggcgcaatcttagtagttgcagcaacagatggtccaatgccacaaactcgtgagcacatcttattaggtcgccaagtaggtgttccatacatcatcgtattcttaaacaaatgcgatatggttgacgatgaagagttattagaattagttgagatggaagttcgtgaacttctttcacaatatgacttcccaggtgatgacacaccaatcgtacgtggttcagcgttacaagcgttaaacggcgtgccagagtgggaagagaaaattcttgaattagcaaaccacttagacaactacattccagagccagagcgtgcgattgataaaccattcttattaccaatcgaagacgtattctcaatttcaggtcgtggtacagtagtaacaggtcgtgttgagcgtggtatcattaaagcaggtgaagaggttgaaatcgttggtatcaaggatacaactaaaacaactgtaactggtgttgagatgttccgtaaattattagacgaaggtcgtgcgggtgagaacgtaggtgcattattacgcggtaccaaacgtgaagaaatcgaacgtggtcaagtattagctaaaccaggttctatcactccacacacagacttcgaatcagaagtttacgtattatcaaaagaagaaggtggtcgtcatactccattcttcaaaggctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcttcaaaggctatcgtccacagttctacttccgtacaactgacgtaacgggtactatcgaattaccagaaggtgttgagatggtaatgccaggcgacaacatcaaaatgacagtaagcttaattcacccaatcgcaatggatgaaggtttacgtttcgctatccgtgaaggtggccgtaccgttggtgcgggtgttgttgcgaaaatcatcaaataatctgtttttagtttaagaagattagattgttatcttaagggctggatgcgatatttaatcgtattcagcccttttatttggtgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattcaaaaaaagaattaaggcgactataataacttctgtcttacaatctcaaacagacaaaccccagtcgccacggatacattcagcgatgataccgatcctgccattggaatactcaccagttgatcacaatgttcacgggtaagacgacgcattccgtccccttctgcccccatcactaacgcaatcgagccagttaatttcacctgatacagactttctgtcgcttcgccagctgtgccgacgatccaaatattacgttcttgtaactcacgcatagtacgggcgaggttcgttactcgaataagtggcacggtttccgccgcaccacaagccactttgcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagttatggggatcggtcacaccgtctaagatcaataagaacggatttgctttgcgatctaaaatttgatcaagatcgctttcatttagctctttagcaggaatgattttggcaataatcccttgatgtacttcgccttgggctttgttatcaagggcttggcgattgacctgttgcactcgaatgcctaaacgctgtaattcgttgagtaatggggttaatcgtttatcttcacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttttagtacaaacacttcgattaatcgttcgggtgcaacatctaaaaaggatttaacagcgtgaataccgtagatttgttcgctcatatttattcttctattctgtatcttatttttcccctctctcgtttacgggagagggtggagaaaaatccgcaggattttcggagggagagggcaattaatgttctcttgttttaaagaactccacatccggataacgctcttgagccaagttgagattaaccattgttggggcgatataggttaagttatcgccaccgtctaaggctaaattctgctcgtttttgcgtttaaattcttcaaacttcttggcatctttacattccacccaacgagcagttgctacattgacggtttcgtagattgcttccacgttatattcggttttcaggcgtgaaacgaccacatcaaactgaagcacaccgaccgcaccaacgattaagtcgttattcatcagtggacggaacacttgcacagcaccttcttccgacagttgtaccaagcctttaagcaactgtttctgcttaagcggatcttttaggcggatacggcggaacaattcaggggcgaagttcggaataccggtaaatttcaagttttcgccttgcgtaaaggtatcgccgatttggatcgtaccgtgattgtgtaagccgataatatcgcctgcgtaggcttcttctgcgtgggagcgttcgcctgccataaaggttaaagcatcggagatgatcacatctttgccgatacgaacgtgcttgagcttcattcctttttcatatttgcccgatactacacgcataaaagcaacacggtctcggtgttttggatccatatttgcttgaattttgaacacaaagccactgaatttttcttcacttgcttctactttgcgtaaatcagcttcacgggcttgcggagcaggcgcccactcggttaagctatctaggaagtgatcaactccaaagttacctaacgccgtaccgaagaaaacaggcgttaattcgccgtttaagaaggcgtctagttcaaattcgtggcttgccccttgcaccagttctaattcgtcacgcagttgctgagccaaatcatcgcccacagcttgatctaactctggattatttagccctttgacaatacgcacttcctgaatggtatgcccttgccctgtttggtagagataggtttcgtctttatagagatgataaacgcctttgaacaacttaccgcaaccaatcggccaagtgatcggcacgcagttgatcttcaacacgctctcaacttcgtctaacaattccatcggatcacgaatatcacggtcgagcttgttcataaaggttaaaatcggcgtatcacgcaagcgggttacttccatcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgatggtacgttcttcaaccccttttgcactgtcgattaccattaaacagctatccaccgccgttaaggtacgataggtatcttccgagaagtcttcgtgccctggtgtgtcgagtagattgactaagcaatcattgtaagggaactgcattacggaggtagtaatcgaaatcccacgttgcttttccatttccatccagtcggatttagcgtgcgcttgtgagcctttaccttttaccgaacctgcggtttgaatggcatttccgtaaagtaacactttttcggtgatggtcgttttaccagcgtcggggtgagaaataatcgcaaaagttctgcgtttatttacttcttgagggtaattatttaatgacattctattctcgttttctttttcaaaaatggtggctattttccctgatttagtcagagatcacaaccgacggggatgggttatattaagatttgcaaactattgacaaaaactgaccgctaataaaattttatttatcccgatcatctacgccaattagcaaatagttgccttgaatatctgctaaacttctaaaaccgatattaaaaatttcacaggccttattacgattaattagacgataatcaaaattatcgtggtgatgtccgtgaaaaatcttcttcacgcccatttttcgagccagttgattaatcactgcaaaaccttgtgggtgtgggcgaggagcttcgtgggtaattaaaatatctgctttttgcgtttctaaaccttccacatctgaaggaaaaattgaggtacggtgacgcagtggtacaccacctcgccaaatacgctcttgtggactatattggcaataatggataggatcaaagaacattgggcggtgaggaggcatccagatatgccctctaaaaacgccccctagtcctgcaatttttgtgccttgtatattgacaacgcgaccgtgaagatttcgttctttccaagcagttccccaaatagcatcatacgcagcaaccgttttactatcgtggttaccgtgaataaaccaaatatcgcagtgttgagccagcttatccaactctgcggtcgtggttaattgcaaatcccctaaaatcactaacgccacattctcacgttcttgaacaaaggggtaaaggtggacgtagctaccgtgaggatcgcccgcaaaaagtatcattcgctcttctcgttttggtttttaaaagttaatgttatggattcttcatttaagatcgcttcaatcactgctttggtttgattataacgatctaaataacttggcgattcaatttcaatataaggtacgttatatttttctaacaattttttgagtaactgctggaagcgttggcgttgtttttgtgaacctaaactacgcagaccatcatcaacccatttagtgttatttgataataaaatagtgacatcaaaaggatattctttaatcatcgaatctaagaatgggtgaggtttgccttcatattgaatacagaatgcttgagtagtaatgtaatccgtatcaatgatcgccactttgtgtgcgtgcttcattgcataatcaacataacgcttatgccctaatgccatttgtggatagtctgaatactgcattgcctgttcatcaccgccaagttgttcaaagacaaattctcgcccgtattcccacgccgatgtcgtattaaatacattagcaagtttgctgactagaacagtttttccgctactttcaccacctaaaatagcgatagttttcacaaagaatggacgcacctcttttggaataaaacgccagtattggaacggattgttgcggatctttgtcgctgatacattaaatgagttacgttcaggatcgactaaatgcacttccaaatttaagtatttctcgtaaggttctttatcttgaatctcactgctaaagactaatgttggctgaatatgtttttcagcaaatagctctttgacacgttccacccagccctcccagccatttggataacttggaataccatcttcaactaaatgatgaataaaaatctgtttttgctgatatttaaaaatctgttgcatccaacgtaaacgatcttcattcgttggcatacgcttcattttactatcacggaacagttgtaaatcacgttcagtatcggtacaaacaataacgtgtagcatatccaccttactaaaggcttcataaatcatattaatatgccccgtatgcactggatagaacttaccaaaaattacgcctactcgttgattttgttcctcaacgatattcaacactttatgcaacgcacctaattttgtcgcacttggatttttaattttccccgacactaattggttaaaataagctctagttacccctgcttgctcgcaaacatcattcacttttagctttaactgtttacgtttttgttgaagataagcaaaatttgtcataagttcgtcctcacattgatagacagaatgataggcgaaatcgacctttttgtcatttaaaaatgtatagtcaagcggtaagatttacataacaaattgcaaaattatgtataaagactttctacttttgcactattcggtataatctctcttccaaattattcctcatttaacaaattatggcgttattgattacccacaaatgtaccaactgcgatatgtgcgagcctgagtgtcctaatcaagcgatctcaatgggcgatgaaatttatgtcatcgatcccgatctttgcacggaatgtgttggacattacgaaacgccaacctgccaaaaagtgtgtccgatcaacaactgtatcatcaccgatcctgagcatattgaaactaatgaacagctttgggaacggtttgtgttaattcatcattcggataaactatgatagctttctgattcgttgagctaattcactaacctgctgccaatctgtatattcatactctctgctagtatctgtatcacctttcgttattttcataataaagcgaatcatggttttatcaaaaaaattatagcgaggatagagtaatgctccagcaaatacttcagcgatatttggtttccatagaattttgtctagcaatttacgtgtatatgtattcgtataaggtgtattacgagttattttacgagcagttaaattgacactaaaaaaaacagatttttttctatttagtagctcataatatcgatcaataaattgttccaatactgggtcaaaatgtccatatcgaatcgatgcgccaataacaatacaatcaaattgttctaatgtttctacagaccaaagagaaaagtctcgtaaggagaaaacttgtgtctcttgctgtagctccttcgcaagatagtcagaaattttttttgtttgtccatcatttgttaaataaaatattgcagttttcatattatgttccctataacctattgtgaaaacgatcttaacaatttaaatttaaaagaactataatttgttttatatcaatccgttaattaaagtattttgattttatttagaatgaaaattaaaattcatctgagtattagctcaattactgttcacttataaaaggagtatatataatgaaatctatttttttacgtacagctttgttagcgtatatgtttgttgcactttctgctcaagctgcccctaaagagccttatactcaagccggatttaacacacgtttagcagagcaacagcaagccccaattcattgggtttctattgagcaaattaaagagagcttaaaaggcaaagccccgatgaatgtgagttttgatattgatgatactgtattagcaagtagcggttgcttctactatggtaagcagaagtattcgccgaatgattatagctatctcaaaaatcaagatttctgggacgaaatcaatgctggttgtgataaatactctattccgaaacaggtcgcccaagatctcattaatatgcatcaagagcgtggcgatcagattttctttatcacaggaagaactgcaggtaaggacgatcaagtcaccccattacttgaaaaaacctttggtataaaaaatatgcaacctgttaattttatgggcggacacggtcaagataaattaaaaacaaaatacaataaagccgcagggattttaaaacataatattcagttacactacggcgatagcgatgatgatattctcgccgctaaagaggctggcattcgtggtattcgtgtattgcgtaccacaagttcaacttatacgccattccctcaggctggcggatatggagaggaagttattataaattcaagctactaataaatatccccgtcttaaaaggcggggatttgctattcccttatagcctttgaatactattcaagtataggttgtacgaaataaattaacagaagaaggcatattgtctagatgagtgctatttttgttactccaattgtgcgatactgtttcgttagactatcccttccaaatataaaatgagaaaaactttctgaatttttaaaatgcaaacgtttgcgtaatccgttataatgccttcaattttgttttctatcattaacggaactgcccaatgactgtacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacctttcgtggctcacctgccttatctgactttcgtttaaaccaacttcaacaaaaattcgagcaacatcaactgcctgttaaatcggtctatgccgaatatttgcattttgttgagctaaaccgaccgcttgtagccgatgaaacaaaaaaaatccaagagttgttgcattatggtccaacctttgcggaacacgagccaaccggcttttgtttgattgtaactccacgtattggcacgatttcttcgtggtcgtcaaaagcgacagatattgcccataactgtggcttatcagcggtaaaccgcattgagcgtggtttagcgtactatttcgagtttgaacaagcgttaaatgaagcagagttggcaaccctaaaaggcttgttgcacgaccgtatgttagaaaccgttttaaccgatgaaaaccaagcgagccaactgtttgcccagcacgaaccgaagccgtttacgacggtggatattttaaacggtggtcgcaaagccttagaagtggcaaacgtggaattaggtttggcattggcagaagatgaaattgattatttggtggaaaaattcacggcgttaaaccgcaatccgcacgacattgagctttatatgttcgcacaggcgaactcagagcattgtcgccataaaattttcaacgcagactggacgattgatggcgaaaaacaagagaaatcgctgttcaaaatgattaaaaacaccttcgagaaaacgccagattatgtgctttctgcctataaagataatgcggcggtaatggaaggttccaaagtcggtcgttggttccctgatcaagacgggcaatatcgctatcatcaagaagatgcgcatattttaatgaaagtagaaacccacaaccacccgacagccatttcaccattcccaggggcggcgacaggttcaggtggcgaaatccgtgatgaaggggcgacagggcgtggtgcaaaaccaaaagcaggtttaaccggtttctccgtatctaacttggtgatcccaaactttgaacagccgtgggaaaatccgctttctaagccgaaccgtatcgcttctgcgttagatattatgattgaaggtccacttggcggagcggcatttaacaatgaatttggtcgtcctgcattacttggctatttccgtacctatgaagaaaaagtaaacagttttggtggcgaagaagttcgtggttatcacaagccgattatgctcgcaggcggtatcggtaacattcgtgccgaacacgttcaaaaaggcgaaattcctgttggggcgaaattaattgtacttggcggccctgcaatgaatatcggtttaggcggtggtgcggcttcgtcaatggcgtcaggcaaatctaaagaagatttagattttgcttccgttcaacgtgaaaacccagaaatggaacgccgttgccaagaagtgatcgaccgttgctggcagttaggcgatgagaacccgattttatttattcacgacgtgggtgctggcggtttatcgaacgcaatgccagaattagtccacgacggcgatcgtggcggtaagttcgatttacgcaaaattttgtgtgatgagaaaggaatgtcaccgcttgaaatttggtgtaacgagtcgcaagagcgttatgtgttagcggttgcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggataaattgccattatttgaagcactttgccaacgtgagcgtgcgccttatgcagtgatcggcgaagcgaccgaagaaaaacatttaaccctgcacgacgatcattttgacaataacccgattgatttaccaatgaacgtgctacttggcaaaacgccgaaaatgcaccgtcaggtttcgtcaaaaaccgtgcaaaacccaccgcttgcacaggaagaaattcagcttaaagaagccttccaccgtgtgttacgcttgccagtagtcgcagaaaaaaccttcttaattactatcggcgaccgctcagtaaccgcaatggtagctcgcgatcagatggtcggcccgtggcaaattcctgttgccgactgtgccgtaaccaccgcaagtttagacagctatcacggtgaagcaatgtcaatgggcgaacgtgcgccagttgccttacttgacttcggggcatctgctcgcttagcagtagcagaaagcattaccaacattgcggcaaccaatatcggcgatattaaacgcattaaactctcggcaaactggatgtcggcggcaggtcacacaggcgaagatgctggcttatatgaagcagtgaaagcagtgggcgaagagctttgccctacacttggcattactattcctgtgggtaaagactcaatgtcaatgcgtaccacttgggaagagaacggcgagcaaaaagcggtaactgcgccactttctctcgtaatttcggctttcgcccgtgtggaagatgtgcgtaaaaccgtgactccacaacttcgcaccgataaaggcacaactcgcttattgttactcgatttaggcgaaggcaaaaaccgcttaggtgcaacggcgttagcacaggtttacaaacaacttggcgataaacctgcggatgtggtgaatgtagaaaccttgaaaaacttcttcaacgcaatgcaagccttagttgctgatgataaattactcgcttaccacgaccgttcagacggtggcttaatcaccacccttgcggaaatggcgtttacacaccttaggcgacaacgatttagctgtattattcaacgaagaactcggtgccgttattcaaatcaaagagagcgatttaaatgcagtgcgtgatgtgttgaaagctcacaacttactacacattaccaaagacatcggctcagcaacggaaggcgatctgtttgaaatcaccagtggcacacgcaaattactcagcgaaaaacgctctgaattgcgtggaatttgggcagaacttacacaccaaatgcaacgcttgcgtgacaaccctgaatgtgccgaccaagaatttgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagaatgtgccgaccaagaatttgcaaccaaaaaagcccaaaataacaaagggttatctgcattcttaacctatgatgtcaatgaagatattgctgcaccgtttatcaaccgtggtgtaaaaccaagtatcgctatcttgcgtgaacagggcgtaaacagccattacgaaatggcggcagccttcgaccgtgcaggcttcaatgcgattgatgtacatatgagcgacttaatggctggcagaagaaatcttaaagatttcaatgcgttagttgcttgtggtggcttctcttacggcgatgtacttggtgcaggcggtggctgggcgaaatcgatcctattcaacccaatgctacgcgatcaattcagccaattcttcgccaacccgaacactttagcccttggcgtgtgtaacggttgccaaatggtgtcaaacttagcggaaattatcccaggcacagaaaactggccacgcttcgtgcgtaataaatccgaacgttttgaagctcgtgtgggactggtgaaaatcaacgataccaactcactctggttcagcggaatggctggctcgcatatgccgattgctgtttcccacggtgaaggacaggtggaatttaaaaatagtgatcaacttcacaatttgcaaaatcaggggcttgtcattgcacaatatatcgataataatcttcaaccaacagaagtttacccagctaacccgaacggttctgtaaacggcattactgccatttctaacttaaacggacgtgtcgccattatgatgccacacccagaacgtgtttaccgtgcggtgagcaactcttggtatccggaatactggagggaagatggggcgtggatgagattgtttagaaatgcgcgtgtggcattcaaataatctaattcttacgagttctatttagaaattttagattgttaattacaatgtaggagcttaatatgaaaaaattattagcaagtatttcttttattatttttatagtcggctgtacacctaaaccatcatataatcagctagctatgcaattacaaatggatatgtctaaacaagatgtgattagcttattagggcaaccaaataaagtatctgctagaaatacagataaagggcacgttgaagtgctaagctattgggggaaaacacttgtcggatttagtatgatagataatcagatgttatctcaagatagattatcagtaaccttattaaataataaagttacagaatggggagataaacttgatccagccgaaatgctggaaaaatcacaagaaatgacgagagagtcactggaaaagattcaaagtaatatcacaaacaaaaagtaatatccctttctccgatagctcctgtttttgacaagatctatcaaagtatagtagataaaatgattgctgatgaatattcttacaagcctttctattaaaaggtataatagacaaatctactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattcattagcaaccactttgtcatataggcatagttttcacgaaattagcaaccattttgtctactatgccccctaaaattaagtaccgaatttatctaaacgactacatctaactcagattttagtttagaagcaatagcccttaataaatgattaagcattgtgtatctttttctatacattgagcgtttattactcggaatatcttcaaggttttttgactctaatgttaagggaagttcccaatattcctttaattcaccattactctctttaaaaatagtatcataatcaacaaaatagcgtgtgctttgaacaaagcgtgacttattctggtatttttgtggaatgccaaataatttagaataccctaagacctgagttaaagctttcatggcttcaaccattaaataggctggacgaagcccatggcattttttagttagttgtttgactaattctttagaaccttcaaagttcggaccttgaataactgcgataagtaatgcattttctaatttaccaaatgtcaataaataaactaattgaccgcttggtttatagcgtaattctaatgcccagaaaccctccattggttgatattcgttgacatttaaatagatttcaaaatcttcaattacttctgtaaaacatatagggctatcccataactgagggagatttttagataagagtactttaggtaaaaagtctaaattgtcacaaatcatgttaaaacgtctttgactattaaagcgtttatctaagaaacgatgaactaaaggatagctataatcggctcttttgattaataacggttttaacgaagattcagaattaattttatgttcaaatttctttatgagagatctatgtaatatagagcgaaaacgataacggaaacgttttaatctataagatttttttcctctatctggatagagatgagacggctcaggccatttataaactgtattgtgcataatgaaatgtgttttcgtgactaatagagccgttggagaatatcacctccaacggacagttattactatattacaacgcctcaatcgccttatactgcgcttgcaatttctcaagtccgtcttggtactcctgcattttttcacgctctttagcgatcacttgttctggggcttttgccacaaaggcttcgttgctgagtttgccttcgatacgtttaacttcgccttgaagtttttcgatctctttggttaaacgagcaagttcagcatctttgttgataaagcctgccattggtactaacacttccgcattacccaccaatttcgccacagaaagcggtgcttcttcgccttgagcaagcacttgtacgctgtctaacttcgccattgcttttaacaagcggtcgttttccgctaacattttacaatgttcgtcagataggttacgcactaagaaatccaagcctttgcttggggcgatgttacattcggcacgaatgttacgcactgccacaatcaactctttcaaccagttgatttgcatttccgccgcttcgtcaatttggttttcttccactttcgggaaaggttgtaacataatggtgtcgccttctacccctgcaaagcccttcactttctgccagatttcttccgtgatgaacggaatgatcggatgtgctaaacgtaataatttttccaacacacgcacaagggtttggcttgcaccacgtttttgtgcgtcagtaccgttagcaaacacaggtttggtgagttctaagtaccagtcacagaattggttccaagtgaactcataaatggtatttgccgctaagtcgaaacggtattggcttaaggcatcacggaactcgcctacggtgcggttgaaggtggattggatccaacgatccgccaagctgtattccacttcgcctgccgataagtctaatttatcgttggtcaatacgaaacggctcgcattccataatttgttacagaaattgcggtagccttccaaacgtttcatatcccagttgatgtctcgtccgttgctcgctaataccgccaaagtgaaacgcaatgcgtccgtaccgtgcggagcgataccgttctcgaactctttacgggttgctttggcaattttttccgctaactgcggttgcatcatattgcccgtacgtttttcgagtagatcttcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgataccgtcaatcatatcaatcgggtctaatacgttcccttttgatttcgacattttttgcccttgttcatcgcggatcaagcctgttacatacacagttttgaacggtacttgcggtttgccgttttcatctttgatgaagtgcatcgtaaacataatcatacgagccacccagaagaagatgatgtcaaagcctgtgattaacacatcggttgggtgatacattttgagttctttggtttgctctggccagcctaaagttgagaatgtccataagcctgatgagaaccaagtatctaacacgtcttcatcttgttttaacgcaacatcagcatttaactgatattttgaccgcacttccgcttcatcgcgcgctacataaacgttgccttccgcatcgtaccacgcagggatacggtgtccccaccataattggcgagaaatacaccagtcttgaatatcacgcatccaagagaaatagagattttcatactgtttcggtacaaattgaatttcgccgtcttccaccgctttagtagccacttccgcaagcggtttcacgctcacataccattggtcggtcagcatcggttcaatcggcacacccccacggtcgccgtaaggcacttttaagtcgtgcggtttgatttcatctaataaaccgagtgcttcaaagtctgccacgattttcttgcgtgccgcaaaacgctctaaaccttgataatccgctggaataagtgcggtgtaatttgtcaaaggtttaccgtctgagccgataatttccgcttccgcacgaatgtccgcatttaaggtcatcacgttcaccattggcaactgatgacgcttaccgacttcgtagtcgttgaagtcgtgagcaggagtaattttcaccacgcctgtaccgaactcacgatctacataatcgtccgcaataatcggaatttcacggtttgcaagcggtaggattacggttttaccgatcaaagactggtaacgctcatcttcagggtgaaccgccaccgccgtatcgcctaacattgtttcaggacgagtggtcgctaccaccaaataatctttaccgtccgctgttttcgccccattagctaacggatagcggaaatgccacagcgagcctttgctctctttgttttctacttcaagatcggaaatcgctgtatgtaatttcggatcccagtttactaagcgtttaccacgataaatcaagccttcttcgtgtaagcgtacaaacacttctttcaccgcatcagacaaaccgtcgtccatagtaaaacgctcacgatcccagtcgattgagttacctaaacggcgcatttgttgactgattgtgccgccagaataagctttccaatcccagattttttcaataaaggcatcacgaccataatcgtgacgcgttttgccttcttccgccgcaattttacgttccaccaccatttgggttgcaatccctgcgtggtctgtacctgcttgccatagggtgttattgccttccatacggttaaaacggattaaggtatccattaaggtttgttggaaagcgtgccccatatgcaagctccccgtcacatttggcggtgggattgcgatacagtagcttggtgcattaacatcttcgctcggtttgaaataaccttgcgattcccagtgttggtagagcgcttgctctacggcggaagggttaaaacggtcttccattgtgaattgttttgtcattgttgttctcttttaataaataaattagttacaaaaatcctgtaattctacttaaaataaataaggatagcaaaaggttaaaatttatccaggcattctgttttatggcttgacataatgtgtgtttttattttcaataggtcagattctattaatcctatgtataaggaaatttatcatgaaaaaacttataaaaatcttacctgcattttgtttattaacagcgtgtgttagccctttcacagcaatattagatgcagattctaagtttattgagcaaaaccttccagcatcaaatgcaaattacggaagcatgcctaaaaactatcaagaacaaataaaaaaatatatggaacaggttttaaaagaccctgattctgcaaaatattctgactttactcgtttggacaagagctatgctgtttataagaaaaataacatgcaagttatgactcataatgatgtctactatgggtattctatttgtttctgggtaaatgctaaaaattcgtatggagcatacgtagggaaaaccccatatctagcatttttccacaaccaaaaagtgatggatattaaagaagttcaaccattactgaatgctgcatatttaggatctaaatttgttgcttgccctaaatagattagaagtgttagcctctgatggtgctcttctccgacgagtgcctatttaaagcccccggtgaagatgggcactatcgtttggtattttacaagcggtctgttttaagaagttttttgcaaaatttttcttaaatccaaccgcttgtcaccctacacgagccgtgtggggttaagcataaccgagccacgctgtggctctttttctaatccccagccccaacggggctgaattatgcgtaacctagtacggctttgccgtgctaggaataaggtaaattttactgaccgactttattttgcataccccaacattaacaactcgttcactaaatcctcacaccattgaggcaatttatctgctaatttagtaacagttttatttgctgaaataacaagctgtattttagggctatctgatgaattatcgtaaataaatgtttcatcatttaataaaattgcttgaattaaattttctcgactaatttgataacgccttttaatcgtctcttcatcaataaaatgcccgcctgcttttactcttgctttgacacgagcaatatttatttttggatcatccaccccgacataatttaaacgagtataaaaatttttcttcgctacttccattctttgcaaaatagatgtacccgatagggttgattccattgaaaaagaaatattatgtcgtattgcaaatttaaatagctctattgcttttctacctgcctcaatatctgccaatcttggattgtcaggattaatttgcattgcaatatgatctgaatcaatcacaatctgcacggaatcccgattaaaagagcgtaatgttgatttacccgctccatttgttccgcagtagaaaatagcaagagacttattgtgcatattcaatcactcgaataaaaccatttgggtgatgctcaatcaaatccccattttctcggcgataagtcaaaacttccttctttttcttttccgctatccaagcagagaataaaacatcaagctctttttgtttttgcagaatttcgtctttcgtcattgttattctcctagcaaggcggtcaatttcatcatattactcacccttcaccatatccaaatgcgctattccatcttccaaataaacttcggaaatcggtttaaatccaagcgattggtaaaaatcttgcaaataggcttgggcttgcacatagaccttttcactttgccattgttgctggcaaacagtgagtgcttgtgtcatcaattttttcgctaaacctgttccgcgcttttctttggtaaccaacactctaccgatatgtacaccatcttgctcgggaataatccgacagtaagcggtcagtttttgcgaattttttgcaaaaaggtgcaaggctttcagatctttttcatcgacctcttgataagcacaattttgctctaccacaaaaacggcgatacgcgcttggtaaatctcaaaaagttcttgagtagaaagctcggaaaatgcttttaactgccacatacgccttgtttcaatcctaagattactaaatcttcaaaatctgtttccatatctgcaacttggggaagttttccccaaatttcaaagcccattttattcagtaagcctaaactttgatcgttattgccgaacacaaaagctaataatgtatgcagttggtaattgggcatttgttcaattaagaaattcacacaggctttaccgatacctttgccatgaacagctttatcaagataaaaactgatttcgcgagagccgtcataagcagctcggctataaaattgcgagtagctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgactgataacttgccatttgatattgccaaccttgctcagaatagagtatcggcgttgctccgtcaagccttgatacagcttgtttcatcattcggcttatctgctcgaaacttgggtttcttgccacatcataagcaataatttcaccgttaaacaagtccttaatcggcgagagataaagtttaccttctgcacacttaaattcactcacatcggtgacccatttttgatttggggctgtagtgtgaaaattctgttttagcaaattctctgcaattttgtcgacttcgccacgataagaatgatattttttgcgtttgtttttccctttcaaaccaagttgttgcagtaagcgttggacttttttatggttaatcagccatatttttcttaattccagcgtaatacgatgataaccgtaattaccgtcatttttgtgataaattttgatgacttcttgcttaatcgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttatctttatgataaatagtcattttttctaaatgttatttctatttcatttcaaataaggatattctcatgcataaaatactttttattattccttcttctccatatggtgatgaacattttttcagcgcatttcgtttagctttacaactacaagagcaacacaaaagtgcggttgaattaaagttattgctaatgtcagatgccgttagcgggggacttgctcatcaacagctggcagaaggttaccatttgcaacaaatgcttgaaattcttaccgcacaaggggcgatggtcaaattatgtaaaacttgcactaatgcacgtggaattacctcattaccaccagctgaaggcgttgaaattggtacattagttgaattagctgattggacggtcaatgcagataaagtgttgaatttctagttgttatcctattcttaatattaggaataaaaggcataacagacagtaggatgacagggcgaaagaagtatttcgccctttttattttatatttcctatttatgagagatgtgttgccctcttcatgttttgtacgaattgtgtcaattcaagcaaacattgagggtgattgtcgaggtttcgttcaataatctgaactgtagcggaacccgagattgcaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggaacccgagattgcaccggcagcccctaaacgcagcgcctctttaacttgttccggttttgcgataccaaaaccttgtaaaattggggcgctttgatattgggttaacccttcaataagaacatctaaattggcagcttgtgtttgattttctgcgctagtaacgccggctcttgagactaaataagtataacctcgagtatgttgagctaccgctttaattgtggattcattagcattaggtggacaaatgaaaaccggctgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcatgacgttgagcagcttggatatattcttctgcggcgagtaaaggaatatctgcaaccaatacggcatcaacgcccacttcggcacagcgtgcatagaatttatcaagagtttgcgcataaattaaattggcacaaagcaacagactaatcggtatgtctggataggttgaccgcactttggcaagtaactgaaaactttcttcggtgctacaacctgcattgagagcccgatcattggcagcctgaataaccggtccgtccaacaagggatcagaaaagggaaagcctaattctaaggcatccgcaccattatcaactaaagtacaaataatctcaaaagagcgctcaaaatcagggtcacaaagtgtcacaaaaggaacaaatcccccttgttttttatcagctaattgagcaaataaacggctgaaacgagatgattgcacaatcatttgatagctccttttgcagttaaaattttatccaccgtgaaaatatccttatcaccacgaccggatagattcacaacaagtagttgtgtttttgttggatcttgcttgatgagttttaatgcgtaagccaaagcatgggagctttctaaagcaggaataataccttcatgttgtgctaaagcttgaaatgcctcaagtgcttcatcatctgtaatgctctcataatctgcacgaccaatagcatggagatgcgcgtgctgcgggccgacagaagggaagtctaaaccggctgaaatactataagactcttcaatttgcccgtctttggtttgcataatcggggatctcatcccaaaataaataccgactgaaccatgacgtaaaggcgcaccatgctcaccggtttcaatgcctttgcctgctggttcaatcccaattaggcgtacacttttttcttcaataaaatcggcaaacataccaatggcatttgatccgccgccgacagccgcaataaccgcatcaggtaagcgcccttccttctccaaaatttgccttttggtttcttctccaatcattttttggaattcacgcacgatggttggaaatgggtgcgggcctgcggcggtaccgagcagataatgtgttgtggcataatttgcagcccaatcccgcatagcctcacagcaagcatctttgagtgaacaagagcctttttgtacagggatcacttcggcgcccattaacttcattcggaaaacattaggcgattgacgttcaacatcttttgcgcccatataaatacggcaaggtatattgagcattgcacaggctaatgcagtcgcaacgccatgttgtcctgcaccggtttcagcaataatacgtgttttccccatgcgttttgctaagagaatttgccctaaaacttggttggttttatgggcgccaccatgcaataaatcctcacgttttaaataaagtgtagtgttcgtgccttttgttaaattacggcaacatgttaatgctgtagggcgaccggcgtaattttttaataaatcctgaaattcttgttggaaagcaggatcttctttcgcctccacaaaggctttttccagttcttgtaaaacaggtactaagatttcgggaacgaacataccgccgaactcaccgaaatagggattaagaatggttgtcatagcatttccttttacatttttatgataattttttaggtgtttgacgctccaaaattttgttaaacaccgctgctaatttttgtgggcttttcatgcccgttagactttctacgccggaattgagatcaagacctaggcaatgttgtgataaggcaagctcaatattgtctggattaatgccaccggcaaggagcagtttagatttatattcttgagggattttcgaccaatcaaaaggctgtccagtccctccacgttgattgccgattttgctgtccaatatgtagcgatccacatggggaatcgacggaatttttaccgcacttttactttgtgttttggttgcaagggcggctaatgtaattttagagggcgcatcaactgaaattgctttccaaatttggcatgattgcggtaattgttggcgaagtgcggcaataaattcagccgtttcttcgccatgtaattgtactgcaaataaatcaagttggttgacgattttttcaataaaatcaatagattgattttgaaatacgccgacaaaacgcaagggagcctgtaccaccaactcttgagcttggcgtaatgaaagctgtcggggagaatgttctgcaaaaattaagcctccatacaatgcgccttgctcatacacggcttgtacatcctgcggacgagtaagtccacaaactttattttcgccaaaaattaaggtgcggacgctttgatggagatcgggacttcccatcaaactgctaccaataagaaaaccatgtacatcagatttcagctgttgaatttgatgatggtggtaaatgcctgattcgctaataataattcggcctgccggaatttggcgtgcaagaggcggtgtacgagcaatatcgacagataaatcatgcaaatcacgattattgataccaataactttagcgccaagctcaatggctcgagttaattctgtttgatttgaagtttccgttaatattcccatgcctaatccatgtgcaatttctgccaatcgacgataggtctcatcatctaacacagaaagcattaataaaatcgcatctgcttgataatagcgcgccaaataaatttgatattcgctcacaataaaatctttgcacaagattggttggttgacgagctggcgaacgcgcggaatataagtgaaatccccttgaaaatatttttcatctgtgagaacagaaattgcggaggcataacttttatatacctgtgcaatatcttctacattaaaattggctcgaatcaaaccttttgagggagaggcttttttacattcaagaatataagccggtttttgcgccgaaccttgctgaagtgcggtataaaaatcccgatcactaggttgaaggctattttgaaacgcactcaaaggaaaatgggtttgttggtgttggatccaaagtaatttatcctgtacgattgttttcaaaatactaggttgcgtgtggttttgtggcatagtgaattccttttaataacgcgttaattgagataaaacattaacacttttaccggattggatgacatccaaaacctgttgtgcgttatgcttgatgttctcataaccaaacaatttcatcaataatgctgtattcattgcaacggcttgggcatgttcaggtttgccttgaccttgtaacagtgcggttatcatttgggcattttctgcaggttcaccaccacgtaaagattccaatggtttggcttgaaaaccaaaatccaaaggagaaaggctgtagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaggctgtagtaggtgattttcccatcatagatttccgctacatcagtccgtccatgaatagccacttcatccaatccacagccatgcacaacaaaagtatgttgatgaccgagttgtgcaacggtttcggcataaggtttgagtaaatgaggagaataaacaccaagtagttgacgttttggtcgtgcagggttgataagcggtcctagaatattgaagatagtccttgtttttagtgcttgacgcacagaaaccgcgtgtttaaacccgaggtggtattgctgggcaaaaagaaaacaaagcccgatttcatccaatgcctgtcttgcaatatccgcctgcatatttatattgaccccaagtgcggttaataaatcgcttgagccggttttgcttgatacacttcgatttccatgttttgcgatttttaacccacaggcagccccaactattgcagaggcggtagaaatattgatagtattggcgctatccccaccggtaccgacaatatctgcaaatgcataatcaggggtagggaagggttgtgccgcattaaggcatgccgccactgcaccactgatttcttcagcgctttcccctcgtatttttagcgcaattaacagtgcagtgagctgtattggatttaattccccttgaatgattgatgtgaaaagctgttgcatttccgaggatgttagatgagtttgctcaataattttaagtaggagttgttctgtttgcatattatattccttgtgttctattaaaattcattaaatatgcgatagtttgtttcaataattgagatccctgtacagtcaaaatactctcaggatggaattgaaaaccacaaatcggtaaagatttatggcgaattgccatgacgatattttcataagtagcattaacaattagctcatcaggcaactcaacacccattaatgaatgatagcgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaacatagctaaattatcatgagaaattagcgatactttgccatgtaacacttcgccagcatgaacaattttgccaccaaaagattcaatcagagcttgatgccccaagcaaataccaatcataggcactttgccttttaagcgtgcaattaatggcagtaaattgccggcttcagagggattacccggaccgggggataaggcaagtagggtattggggtgagctaaggtggcttgttctaacaacgctatatcacaatcgttacggtaaatctgaacctgatgacctaatgtccgaaattgatcgactaagttataggtgaaagaatcaaaattatctaaaaaaataatggttgccatgataaaaatccttatattgcactgtgagtttgaataatggcattaatcactgctttagctttatggcgggtttcatctgcctccatttgtggatcagaatctaacacttcgccacagccggcttgaatatgcgctattccgttttgcacaaaagcagaacgaatcacgatacaggtatccaaattaccttttgaggacaaataacccaccgcgccaccataactatgtcgtttttgttgttcaacaaggtaaattaattgcatcgctttaatttttggcgcaccggttaaagttcccatattcatacaggcttgataagcatgcaatgcatccagttcagggcgcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgcatccagttcagggcgcaattttcctacgactcgagaaaccaaatgcataatgtgcgaataacgatcgatttgcattaatgccttaacatggcgtgagccactttcacacacacgcgccacatcattacgagccaaatccaccaacattaaatgctccgcaagttctttcttatctaagcgtagctctaattctaagcgagcatccagatctggatcgatttgaccttgctcatcaaaacctcgcggtcttgaaccagcaatcggataaatttccacttggcgtgtttgtgcggaatatttcaatgcgctttctggtgaggctccaaataaagtaaacgcctcatcttgcataaagaacatataagggcttggattggtttgttttagttgtcggtatgcccgaagaggattcggacaagctaaagaaaaacgtcttgatggtacaatttggaatacatccccaatatgaatatgatgtttaagtgaacggataatatctttaaatgcctcatcttctaaattcgtgcgaacttctgtggaggcgaggatgtgaggcaagtgcggttcaactttttgcaaattttggcaaatttgcaccgcactttgattcaagtcatcggctgcctttggatgaaagcaaaaggtttgcaatgtcgctgacagggtttgatgatcaataagtaataaattttcagccaaataaaagacataatcagggcaactcaaaccatcgtcttttaattgaatattttccataggaataaaattggtgactaaatcataagcaaataatccccctaagaaaatcggaatatcgctatgctgataaagcgttgttaagcaacgtaatccatcaaaaatcgacggggcgcttagcttactgtcttcatcaagatttgggtttggcaaagaaaacttcaccgaaagatgatgggtatcaaacgaacttatttcacaaataggctgtaattgttgtgcgatgtagggtaaaaccccttgcccatttaaggtcaatgcctcgaaatcaacttgttgtccttggcaagaaatttttaatgcggcatctactagcaacaaactttttaaactgtttttactttggatttcagcagactctaaaagcaaggtattttgtcggttttggcaaagtgtcgcaaaaatggcgatgggatcattgcaataatccacatgatattctttggtttggataaaaacggactgcatttttaacatcctgtcatttgttaattttgtactattaaactagtataaattaatattgtcaactttttttagaaataattattggatgaaggaaggattcaagagaatatgaagtaggttttgggatatttagagaagggcaaaatggggttttcattaaatcaaccccattttttcggtaatatgaccgcacttgaaaggaatgactattttaatcctttcactaagtaatgaatctgccatgttaaaagttgtttataagcctgaattcgcgcccgttttttatcactcactggtttcaactcggtaactcaaagattgtcaggataaagtgcggttggattttgccaagaatattgcgtgagatgctcgccatcgctcaccccttcgctatcggcataaagcccttcgttataagcaaaagcatatttttcattgtcttgctccgccaacaaattgcgcccgcctaggttccaatattccgcatctgataagcttaaaccatataatgtaggcataatatccttgtgcgaaccaatgcggcttggatcaaatttaagggcaagtttgctctgtaattccgttggaacatgaacataaaacggtacgcccattgccataaaattctgttttggcgcatcgaaacgcacgcagcgcacgtggtgatctcctgtagcagcaataatggttcgatttcccaccgcactttgcgccacttgtgtaataaattgccccaaggcgttattagcatattgataagtggaaagggatttgcggttttcttcttcactgccaaattttccttctagtacttgaggattaatacgctccgccttgtaatgttgaggtacttcataaggcggatgattcgtcatacttaatatattgataaataaaggttcattactttctttcagtaatttttctgctaaggcaaaggcatattcatccgcaatgccccaataagacatggtaggttttgcatcaggaaaagtttcgataatatcattttggtcataacattcatccacaccttgcaacggcaaataattgcctaagttgcgccacattaaaccaccagatgtgataaacaccgtacgatagccttgttgtttataggttttaaatggactatagggcagggcgatttgctgtgcagctgattggctgatattttgaatagggctataaaaaagcaacgatgccaaagttggcgcagtgccgttataatcagaggtaaagcgtttgaacacaaaatcttgttcaaagtgcggccgtaattgtcccaataaatcattggtttcagggttatctaaaaccaaataattggtaccaaagctttccattaaggcaaatacaacatgaggtttgctttccttcaatgcaggattaacaggcgtacgctcaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaggcgtacgctcaatcaggctatctgtgccaaagacttgttgcattaaggctttaccttcgtctaaatcaaccacctcaaaaagaatattgcgtttacgatctctaaatgcccattccacagcaattacgccatttgggactagtttattgataacggctaaagaggaaacttgcgaatgatctttggttaatggtttggagcgtattgtaccgcgtacaaaaaatgccaaggcaaggaatgagccaacaaaaagcaaagttgcaacagaccaatgcatatcccaatttaacaatccttggtataacgcataatacataaagtacgcaggaagcgcagctaacacaagcactgcgagagatcctgaaataacagggtaatcatcatagatatttttcaacacggctttggtatcgtcttccactaaaccaaacatcaacatatcgtaataattgttataggttttatagtaataaaaattacccaccacaatgccaatgagcgcgatagcaaaaattaagatgtaaattgcccaaaaaagtgcggtggtttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggaacatttaaattttacggtatttcgtatgctgtttcacggctttacgaatttgtcgagtactggtacgacgacgggcttttgtcacatcaaccttagtttccgtttcaggttttaagccaaccaattcacgcaagtagttcacttgctctaatcccatctcttcccaaccaccacgcggtaaacttttttcaagtttgatattgccgtaacgaatacgaatcaaacggctaacttgaatcccctgtgactcccataaacgacgaacttcacggttacgcccttcggttaaggtgacatcaaaccattggttaatccctgtaccgccaactgctttaatctgtttgaaattagcaggaccgtcttccaactgcacacctttgcgtaaacgttgtatcattgcgtcattcacttcgccaaatacacgcacagaatattcacgctcaacctctctgcttgggtgcattaaacggttcgctaattcgccatcagtggtaaatagtagcaggcctgaagtgttaatatccaaacgccccaccgcaatccaacgagagcctgttaaacgtggtaagcggtcgaataccgttgctcttccttcaggatcagaacgcgtacagagttcgccttcaggtttgtagtacatcaacactcggcagatctctttttgagttggaattaggttaactaaattgccgtcgatacggattttggtgctcgagctaacctgtacacgatcacctagtgtcgcaattttaccatctacactcactcgccctgccgcaatcacttcttcaatttcacggcgagagccttgtcctgcacgagctagaattttttgtagtttttcaccgacgattttgtcgtttgctttattttccgtttcaatggaagcggttggtttcggcgatttttttacaagtggtttacgattttgggtttcttggcgtgtattactctgagtcggtttttgcaacgtttttgcagaatctgaccgcttggttgcagttggtttacgaaatgtcgtcatttaagttccttatttgtcgctttcacaagcgtcggggtgttatttactatacttcccccgcttgagggggaagatgcccgaagggcagaagggggggagcgtataatccctctccctccgaaaatccttcggattttctccaccctatcccgcaagcgggagagggatattatgcttcaaaaggtgtcggatcgcccgaacccactcgaataatttcagggctatcttgagttaaatcgatcactgttgtcggtgattgccctaagtaaccaccgtgaataattaaatcaacgtgatgttctaaatgctctcgaatttcatcaggatccgattgggtaattgcttcatttggtaatattaatgaacacgaaagaatcggctcacccaaggcagaaatcagagccaaagcaattacattattcggcacacgaataccaatcgtcttacgtttagtcattaaacgacggggtacatctttagttgcaggcagaataaaggtataaggatttggcacattatttttaatcaagcggtaagattgatttgtcactagtgcataagtcgaaagctctgataaatcgctacatacaagcgtaaagttgtgattttcaggcaaacgacggattgccacaattctgtccattgcgtgcttatcgccaatcgcacaacctaaggcataaccagaatctgtcggatagacaatcacaccaccatttttgatgatttccactgcttgattaattaagcgttgttgtggattttcggggtgaatatagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcattttgcgcttccgtgtttttgtaaaatatattttagcggtaatgaatttttaacaatttgaatgtgatcacagtttattttgagtgactcttataaaatctgaacgttatttcatataggaggcaattatggctgactcgcgttatgcttcgttaaaaaaaactgactaaatatcctctagcattagccagaaaacgtagggtgcttttctttctattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgcttgtttttactttttttatggcacatcttctttcagatccattatttaccccaactcaaagaaatgtgatgtttttactcttttttgcgatttgtttatgggtaactgaagctattccgccgttttcagtaggtattttaatcatcggttttctcgtgttaattatgggaaggcacgatgcacaaaatgcaatgaaatatctacaaacctggtcggatagtgttatttggctctttctaggtggttttttccttgcggaagcaatgaaaaaaaacagcgttagatacgttattgttgaaacatttattacctaaatttggtacagaccctcgttatgtactttggggattaatgttgattactgcactaatgtcaatgtttatgagcaatacagctacaacagcgatgatgattgcgacgattagtcctatttttgcgaccctagacaaaaaagctaatctatctagagcattactactaggcattccagccgctgcttccattggtggaatgggaactatcattggctctccacctaatgcgattgcatttagtacagggctaattcaacaatccgaatttagattagggggaatagttattggtttattaggtcctgctttgagcattatatggggctggtttattattgagttgctttactaatcaatagaaaaaaactaaaaaggcagtcgctaaaataggaatgataacttagtgactgcatattttatttctgatgactaatttttcacagtatctagaataatgttttgtaattgctgcagcccatttaaccttgtacttgtcaaatggcgagttatctgcaaatcatcaaaaagcggttgaatttcaaaggattgcaatgcttcagctgatttttccgtaacaaaagcaatcaacaccactaacaatccttgcattaaacgagcgtcgctataaccttgtacttgacgtggctcaagctgaaaattaaaccataaacggctttcacaaccgtgaatttcttgccactgttcaagctgttgttcggttggtttgggtaattgacggcttagttgaattaacaagcggtatctttcttcccaagatttgcaaagggcaaactgggcattgatttcatcaaatgtcataaaatccctatccaagtatcggtaataaaagagctatatcatactgcgattttttgttaaaatcccctgatttttaccgatttgtaatgaggaacacaaaatggctgtaatccctatggtcgttgagcaaagctcaaaaggcgaacgtgcctatgatatttattcccgtctgttgaaagaacgtattattttcttaaatggcggtgttgaagatgaaatggcgaaattaattattgctcaaatgctctttttagaagcagaagatcctgaaaaagatatttatctttatattaattccccaggtggtgtagtcacggcaggtttagcgatttacgatacgatgaactttattaaacccgatgtatctacgttgtgtatggggcaagcctgttcaatgggggcatttttattatctgctggggcaaaaggtaagcgttttgcattacctaactctcgtgtgatgatccaccaacctttaggcggttatcgtgggcaagcgacggatattcaaattcacgcacaagaaattttaaaactgaaagagatgctgacacgcaaaatggcagaacattgttcacagccttttgagaaggtggctcaagatacggaacgtgataattttatgtctgcggaagaagcgaaagcctacggtttaattgatgacgttgtaacaaagagatagtgaataatggcaaattttgagaaagaaccacattgtagtttttgcgggaagcgtcgtaatgaagtcgatgcattaattgaaggtacagaagggcatatttgtaacgaatgtattgatgagtcttatgcgttaattaatggaacagacgaaccattgattgatgaaaatgaagctgagagccaagatgtgttaggtaatgtgcctactccacatgaaattcacgcacatttagatgattatgtgatcgggcaagaacacgctaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggtgttgtcggttgcggtttataaccactacaaacgcttacgcaatgcactttctgacaataaagagagtgaaggcgttgagttgggtaaaagtaacattttgcttatcggcccgacaggaagtggtaaaacattgttagcagaaaccttggcacgccgtttaaatgtgccttttgctgtggctgatgcaacaacgctgacgcaagcaggctatgtgggtgaagatgttgaaaatgtgatccaaaaattgctgatgaagtgtgattttgataaagatcaggctgaacgtggcattatttttattgatgaaatcgacaaaattacccgtaaatcagaaaatccatcattgactcgtgatgtatcaggtgaaggggttcagcaggcattacttaaattgattgaaggtactatcgcgaatatcaatccacaaggcggacgcaaacacccgaaacaagaaacaatcccagttgatacctctaaaattctctttatctgtggcggtgcatttgcagggctagataaaattgtcgaagctcgaacgaatacacaaggtggaattggctttaaagcagaattgaaaaaagataaagctcgtcaagcactcactgaattattcaaacaagttgaacctgaagatttggtaaaatttggtttaattccagagctaatcgggcgtttgcctgttatcacaccgcttgaagaacttgatgagaaagcacttattaacattttgacagagccgaaaaatgcgattatcaagcagtatcaagccttgttcaaaatggaaggtgtggaattaaaattcaccaaagatgctttagtggcgattgctcaaaaagcgatttctcgtaaaacaggggcaagggggctacgttcaatcgtggaaaacttgctacttgacacgatttatgatttaccgtccttgaaagcaagtaaagtgacagtaggtaaaaactgtgttgagaaaggtgaaaagccgaaggtggagtaacttaattgatattctccccgtcctaagggcggggatttttactagaaacttttccattactgaatcaagttaactaatttggtataaccgaacacaaaatttggtaataaacttctccacatttacctaagtcattcacattcacacattcattcactttatgaatggtttggttgattggaccgaactcaaccacttctgcgcccattaaggcaataaaacgcccgtctgatgtgccaccgccagtgtctaatttaggtgtaatttgtgtcaccttttcgaccgcttgtatcgtggcttgcaccagttttccgttgcccgctaaaaatggttttcccgacaaattccactcaattcgatgttttaaaccgtattttcgcaacattttggcaactttggttttgatgatttcatcatttacttcggtgcaataacgtaaattgaactgcacataaagctcgcctgggatcacgttattactgcccgtgccagctttgatattggcaatttgcaggcttgtcggtgggaaaaattcgttgccgttatcccattggtaagcggtcagttcgctcaaaaatggtaaagctgtatgaacggggttttcagctaaatggggataggcgacgtgtccttgaatgccttcaatataaaggttggcggtaatcgagccacggcgaccgtttttcaccacatcgcctagctgtttggtgctggatggctcacccactacacaatagtggatcggctcttggcgttgcattaaggtttccaccactttcactgtgccgtctttggcagcagcttcttcgtcagaagtgataagcaaggcaattttgccctgatggttcgggttgtttttcacaaaggtttcacaagcgatcaccattgccgctaaagaacctttcatatccgccgctccacgcccgtaaagcatatcatcgacaatttcagcggaaaacggcggataagtccattggctttcatcgccctcagggacaacgtcagtatgtcctgcaaaggcaaggcaaggttcgccttcgccgtgggttgcccataaatttaaggtgtcgccaaaaggcaaccattccagcttaaatccgaccgcttgtagtcgttcagcaatcagttgttggcagccttcatcattcgggctgatagatttacgttggataagagatcgactaagagagataatttgattttgcattttatttcactgtatttgctaaattattgaaaccttacaacaggtatatgcctatttttctttatgaagaaaattaagaggattcaaattttagcaataatcccccacaaagtcgaaaggctaataaagggaataaaaggcaatcgggtaagtttttgcttggtgaataaaaaatagatggcgtaaaacgttaaaccaaataaagacgcataaagcagtaataaaatcatctcatcaaaggtaaacaaaggggataatgcaataaagagaagaatatcccctaagcctaaactctcttttttgtagattaactggctaagtagtgagaataagctaaaaaagagaatggtgataaaaagcgaaaaaatatgggaatttagctcaatggaatggtaaaaaagcagttgccataatgctaagacaaaaataattgaaacatagcgaatatccgttaaataatataaatagtccaataaagataaataaattagacagataagaataaaaataagcggtaagtttatatcgtaaaatatccaaactataacaggaaataaaatataaaagccgtaggataaaaatgtaaatttaggctgtaaagtggatttatgaataaaatccgccaaacttaaaggcgattggactaataaatggtaatcctgataagtttgctgattaattcgtgttggaaaatgttgcatttctttttgaaaccaataagcaagtaaaatcgacaataaaaataacatcattctatcattgctcccatatcaaaaatcggcaaatacaaaccgactaaaatagttcctacaataattcccattaacaccattaacatcggctctaataattgggaaagtatatcaatttgataatctaaccgctgttgataaccgttgctgatttgttgcaacattggcgataattttccgctctgctcgccaatggcaatcatctgtaacatatccgtaggaaagagttttggatctaaactgtcggctaaacgatagccttgttttaaataagttagtgtagttgctagagaaccttgtaataaaatatcatcacttttattggctaaaaaggaatgaagtacagtatctaaacgaatatgtgaagccagcattaaactgctattttgacaaaaaaagataatgcgtgaatactggataatgccttttaaaataggaatatggcttaatataataaactttaggcgtttaataagatctgtttttttatttaaaatatgaattaatagaaaacataacacacataaaataattagcgttaaaatagagtgttgtagaaaatgggataggctaaagagtatttcggtaattagagggagtgattttccttttgaaccataaagttctgcaaattgtggcacaataaaaagcaataataaaatagagagtgtgattgaaatagctaaaataaagacgggataaaagagaatttttttaattttcttggctaatttttccgatttttcacggcgttgtgcaatgttggttaaaattagccctaaattaccgcttgtttctgccattttaattaattggatttcttgtggattaatatattttccctgttttttaaaggcaacggataacgcaaagccggcttcaatcaagcggattgtttcttgttgccaacggtaaaaagtgcgattttggcaggtttcaagcaacatcactaaactctgttttagggggattttagcttgaattaataaggctaactgttgcataaattgattaatttcttccttttttggtgcagtcggcaaggcaaaatgtcggctaatgcttaactggctgtatcctttttgttgcaaccgtttctctagcacttctcggctttcggcaagctgtcgccctgtctgcttttgcccaaagcggttgcgtcctttccattgaaattcataaatgttattcatcgcctaataccctatccacttcgatttcgttggttagttgttgttcaattttctgtttagcactctctcgtaggctggaaaaatccaagtaagcggtctgtttatcgaatttttttgccgttctgcttaaacattggtaaaccccgatccgccctctatagccttgatagcactcgtcacagcctactccacgacactttttacagagcttacgcacaaggcgttgtgcaatcactaacagtagtgaattttggatttcatactcttgaatacccagttgcaacaagcgttcgaccgcagagagtgcgtcgttggtatgcagggtcgaaaggactaaatgccccgtctggcttgctcgtaacgccattttggcactctcttcatctcgaatttcgcctaacataatgatgtcgggatcttgacgtagaaaggtgcgtaacagctggctaaaatccagttgaatactgcgattaacttgggtttgaattaagccgtcaatctcgatttccaccggatcttcggcggtgagaatatgtttatccatttggttaagatagtttaaggcactgtacagggtgatgcttttgccactgcccgttggtccggtcactaaaatcagcccctgtggttgtttcagggcgttgagcagtgtggtttgctgttgtggattaaagccaagttgtagaaaatcaaaactggtcggcttgtttttttgtaagcgtaataccagtttttcaccgtagatcgtcggcaggctagacacccgaaaatcaagggtatccgcaagggcggtggtaaaactaaattgcccgtcttgtggctggcgtaattcgctaatatctagctttgccagtagttttatccgtgaaattagtcggcttgccagctgaatagataggcttttatacaggtgcaaaacgccgtcaatgcgtaagcggataatcaatttttgcttgcgtggctcaatatgaatgtcggacgcattctgagctagacaaaatttaaagagattatctagcagttgaataatcggatcgtttaggttgagctgttcttgctcctgttcaacaaaagccagctcgctctcttcataaatgggctgttgttcaggcgagagagcgttaagcaagtatttcagttcatcagaagcaatcaccactggctcaatctgcttatgggtcataaaagcaaagatttcgcaagcggtgagattgttttcatcatcaacggcaagccataatttatgctcagtttcttgcacaggaacggcaagataacgcaataacagctctttttcttcgcaattttgttgccaacggctaggcgatatatcaaaaatgcgttcggtttgttgttcgcagacggtgtattgggacatagttaatccttatctatataggggtagaaaagtcctaccccatttgtttacggtgtagctttctgcccacaaaaattcgcagggaacaaactaatgtcagccccttgacagcttgttgcccaagtgatgttgttattagcaaatttcggggtcattgtgtagccgtagccatcaatattgcctttacctgccacggtgattacccccgaagcgacggaaatagatttaagatattttgcgtcagggacatcggatttatctgctcgaacgccatttttacctgaactacattccgagatttttttatcccctacgttataaatacaaatttccacatcggatttataagatgcggaagcacttaataactcagagagagctgccttttgggtgtaactggtgtaagacgggattgcaatcgtggctaaaatagcaatgatggcgatcacgatcatcaactcaattaaggtaaaggcttttgcaagcggtcgaattaatctgatttttttcataaattgtccttctaaaatgaatgcgtagaatttacgccttatttactctgccactttttataaaaaatgcgatgagcaacatttattttttcgatgtagatcgaaaaaatcgttttttcttcctgttcatttacacagtatttttgctaaaatagggcaattttttgatttgagagtgaaatataaaatggcaaaagcaccaaaaaccgcttatgtatgtaatgattgtggcgcggaatatgctcgttggatggggcagtgtaaggcgtgtttagcgtggaacactattagcgaagtccgtctgatttcggcaaaagagagcaaaagtgaccgcttgagtggctatgcaggggaaacgacaggcaaaattcagcgattgtctgacattgatttgcaggaagtgccacgttttagcagtggtttttatgagctagatcgtgtgctagggggcggtattgtacctggtagtgcgattttgatcggcggacaccctggcgcagggaaaagtaccttgctcttgcaggtaatgtgcggtttatcacaaagtgtgccgaccctttatgtgacgggggaagagtcgctacaacaggtggcaatgcgtgctaaccgcttgggcttgccgacggataatctaaaaatgttatctgaaacctcagtcgaacatatttgtaaccttgccgatcaggaaaaacccaaactgatggtgattgactctattcaagtaatgcaccttgcggatattcaatcttcccctggcagtgtggctcaagtgcgtgaatgtgcggcatttttgacacgttatgccaaaacacgtcaagtggcgattattatggtcgggcacgttaccaaagatggaactttagcaggccctaaagtgctagaacacgccattgacgcttcgctgttattggaaggggaggcggactcgcgttatcgtaccttacgcagtcagaaaaaccgtttcggagcagtgaacgaactcggcgtatttgcaatgacagaacaaggcttaaaagaagtgaagaacccttcggcgatcttcttaagccgtagcgaagaacagacttcaggcagttcggtgatggtattatgggaaggcactcgtccgttgttggtagaaattcaagcattggtcgatcactcaatgcttgccaaccctcgccgtgttgcggtggggctagaacagaaccgcttatcactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaccgcaagatttggtggtctttggcgaagttggtttagcaggggaaatccgccctgtgccaagcggacaagagcgaattagtgaagcagcaaaacacggctttaaacgcgcgatcattcctcacggcaacgctccgaaaaaagcaattaagggaatggaagtctttaccgtgaagaaattaagtgatgcgttggatattgtgaatgatctataagcattaggaaaatgataggagctataattaaactcctatatgttctcccattctatacttcagacaatagtgatgctatcaagaactgatagcgttctgcctgcaccgcttgttttaaacgctctgcggttaaaatgctttttaattcggataatgctgtttggaaatcatcatttacaatcacataatcaaattcattgtagtggctcatttcagaaacggcttcactcattcgttttgcaatggtttctgccgaatcttgcccacgaccaattaaacgtttttctaattctgcttttgacggtggtagaatgaaaatagttttgacatttggcactttttcacgaatttgtcttgccccttgccagtcaatatcaaggaacacatcaatcccttgctcaaggctacgttcaatcattggcaatgatgtaccgtaatagttaccaaaaacttccgcccattctaagaaatgtccttgttcaatcaggcgtttaaattcatcgtgttgcgtgaagtaataatgtacgccgtgttcttcacctggacgtggattgcgtgtggtgtgggaaatggaaagttgtacttgtgaacgaggaagatccgaaagtaacgcattgattaatgatgattttcctgcaccacttggggctgagatgatatataaatttcctaagctcataatttatttagtgttgttctcacaatggtcttgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacttttaccaataaagctgcccgtgaaatgcgtgagcgtgtggcacattctatcggtaaggaaagtagtcgaggattgacgatttcaacctttcacacccttggttttgagattttaaaacgtgaacataaattactcggctataagtcggggatgacgctgtttgacgaacacgatcagctggcgttgttgaaacatctgttgcctgaaaatgtgacggaagataaagatctgttgaaattgttggtggcgaccatttctaactggaaaaacgatctgcttttgcccgaacagacgattgtcttagcaaaaagcgatcgtgatcgggcgttcagccatttttacgatcaatatcaaaatcagctcaaagcctacaatgctttggattttgatgatttaattatgttgccgactttgctgtttaagcaatttcctgaagctaaagagcgttggcagcagaaaatccgttatttgttggtggacgaatatcaagacaccaacaccagccaatatgaattgattaagctgttggtcggttgtgatggcaattttaccgtggtaggcgatgacgatcagtcgatctactcgtggcgtggggcaaagcctgaaaatatggggcggctgcaacaggattttccgaagctcaaagtgattaaactcgagcaaaattaccgctctagtcaacggattttgcactgtgccaacattctgattgataacaacgatcacttgtttgataaacgcctcttttcgcagttgggcgaaggcgaaaagctcaatgtgattgaagcaaaaaatgaagaacaagaagctgaacgtattgtgggtgagttgattgcacaccgtttttcacgcaaaaccaagtataaagattatgcaattttatatcgtggcaatcatcaatctcgcttgttggaaaagttgctgatccaaaaccgtattccctacaaaatctcaggcggaacgtctttctttgccaaagccgaaatcaaggatatgttggcctatctgcggttattggtgaaccaagatgacgatgcggcatttttacgcattgtgaatacgccgaaacgggaaatcggggcggcgacgcttgaaaaattagggcaacttgccaatgaaaaacaggtgagcctatttgaagctatttttgattttgaactgatccaacatttaaccccaaaaccgtatcaagccttgcaggactttgctcgctgggtggtggaattatccgatcaagcggtcagatccgagccgaaatctgcaattcaggatatgttggcgaaaattcaatatgaagcctatctctacgaaacggcagcaaccccgaaatccgcagaaatgcaaagtcgcaatgtgcaaacactgtttgaatgggtggagaaaatgttggaaggcgatgaactcagcgagccgatgagcttaaatcaagtcgtcaccaatttgactttaagagatatgatggaacgtggcgaagatgatgacgaaagcgatcaggtgcaactgatgacattacacgcctctaaagggttggaatttccacacgttttcttgatcggtatggaagaaggcattttgccacaccaaaccagtattgatgaagataatgtggaagaagagcgtcgtttggcttatgttggcattacccgtgcacaacagacgcttactttctctttatgcaaagaacgccgtcaatacggtgaagtgattaaacccgaaatcagccgatttttactcgaattaccgcaagatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaccgcaagatgatttgcaatgggaacgagataaacctaaactgagtgagcaagaacgccaacaaaaagtatctgctggactgaatagcttaatggctatggtacaagcgaataggaaatagaatacttcatgttatcgaacaatttgtattaatggtgaaatatcatcgtttacaaagatttctttttcagccattgaggctatttgttcgtgggaatattttttggcgttgtatacaacaactatgcttgtatctccaatatgtaaaaagtgattttttccaaaatctgtgtaacacgttgctccgatactaataattgctttattgggataatctgcttttttaattagttcagatatattattcattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcttgattgggttggttgttcattctatcaatgatccaagctaacaatttctgatggaaatagctatagctaataactggactatctaccccatattccgaaagtttgccatcacgtttatgaaaacaggcaatgtggtagctatctaaatttcccccctgttcaaatttatctaatgcaatttgtgcagaagaaataccttttgaatgggctccccaatttttcttttcgcaaattttacgggcatcaggccggcgaattgaacaatcattataggctgcaaaatgtgttggttttaatgcaatcacacgaccttctttatattcaatatcacaaattaatgcaacttcaggttcaatttggagattatctgctttctcaggaaaaacaatgatatcgtgagagagagggtatgttgaaagaaattgttcatttttgtctagatgttcgctaggaacataaaagggaaaaatagcttttggttgatgaacttcgctagtttgaattttcacaaaatccctatcctctccagcttgttctaaatgcccagtaaaattaccagcaacgcccagtccaatgaatttagaattttccatacctaatctccaagaaattcaatatatgtaaatattattttactgattttatacagaaataacgataggtattgtaactatttgttattcaggtagttctttttaatacctattaatatgatacatatgtttttgtcaattgtatttgtttttcaataagttagcattatactccaaagattttaacatcggaatcccatagtgttcaaatatcaatgtacgggaatatttcgtatcaatgataattcaatatcaatttttcttaagagagtcaatcaatgaaaaaatgatattgagagtggttaataaccatcaaacaaaagacattgttttgaacggtgctaaaacggctgttcaaaaagcagagaaaggaacaaaataccaactagtagatgaacatggaaatttaattactaatgctaaagcggaagttgttggaaacgatcttgctatttcggtagaaggaagtcagcaacctagtttagtgttacaagattatcaactacattatcctatagaaaatgtacaatatttagcaaatactcaagcctcatttgctacagcagaaagtgccgcagctgcagctgagatttcggcggttgcttccacaagtatcgcatcaacattaagtacagcacaactggttggtcttagtttaggtgcggtaactgcggcaacagctggcgttgtatcagaaacagttagaaaccatacgagtaaatcgtcttcattctcaaaatcatcaatgcaatcaaattatgttgagaatagtgtaccccaaattactctaggtcagattaccaatgataaccttattgattatatagaatctcaacaggaaaaaattacgatcactgggtctgtgactaatgcaaataacggtgatattgttacgttgaaagtaggggaagcagtatcaactggtctggttacagatggacgttttgcgattgaagttaccgcaaaagataagatggataacccagcaaaagctcctgtagaaaaagaatatcaagttgatacgattgcacctgaagtcaaactcggccttgaacctattgcaggcgataatgcaattagcagcgatgaacgttcgggcaatattacgatttcaggtagtgatgctcaggcaggacaaaccgtaaaaataatggtaaatagccaagaaaaatcggcagttgtagatagcaatttaaaattcaaacttgaagttccagcaagcgatcttattgcgaccgataaatatgtggtaaaagcaagtgttacaggcaataacaatgcttctgccaatactgctcgtgcttatagtgtcgataaagaagtcgttgctcaaattgatattaagaaagtgggcgacttttcgttaaatatgggcgaaattgaaccgcttgtacgcattaaaggcaatgttgagttcactgatgtctatgctgtgggtttaaatcacaaacgcttgcttgaagtgaaagtgaagtttggcgataaagtttataaggctggtttccacgataaacagttcttccttgatattcctgcaagtgaattagctgaattaaccgggaaggacgtttcattatcgttttctttagcaacaggcgttaagggtgactaccataacaatatttatgggctaaccaaaaaagatgatggttcctatgcgacttggatcagttatggtacaagaacacctgcagtgaaaacagtaactttcgacagtccacatttagaaagacaatctgataccagctacaaagcaaattacaaagcagaacaacaggttgaggtaagcggaactgttacagcagcggcgaatagctctgtgaaagtcggtgatactgttgtggtcaaagtaggtgaaaagagctatgaaaccaaagtgcaagcgggtaataccttctcgacaatggttgataaaaaagccttggtccaaacggataaagtaacagcaacattaacaactaaagacttggctgaaaaagagatccaagtaactgatgtagagagagttgtaacaccaagtaatataagcagtaagcacgttattgtacaaaatcaaccaccgaaagagattaataatgatcactctactgatggctataatttcccttattttattgaaaaagtgcaagatgatcattcacaagcgggttggagcacggcttattttgtcaaacgtttaggtggatttggtctgagctacaatgtaccggcaggttcaccgcaagagaaacctgcggtgattaaatattatttccacggttcagagcaattggagtttgaaacaggcggaagtgttccaagcgatgcgttacaagatacgagattgaaagagatttttagagaggtttatgatcaatactcaagctatcttaacgttgaatttgtggaaagtaaggtggttcctgttacagatagacaaagtttagtgattaattttggcaaaatgacgaacggttctgctgctgtggcaatgagcgggggaaatatcacttggaatgcagcaaatgattataagagctggggcgaggattacagttattacaccgcattacacgaaataggccataccttaggaatgccgcatactgattccacaacagaatttggtaaagactatttgattgaagacagttctgagttttcagtgatgtcttataaccgttatgtaaacaatagcttatatcagaagttacattctttgcgaatgtatgatttagcctatttacaaaatcgttttggtgtgaatgcgaaatctcgtgctggagatgatgtttatacctttgctgattttaatacttacgcctccgatggtggtcgttatatttgggatggcgcagggattgatacctttgacgcatctaaagagcaagcaggggtctatgttaatttaaatccaggctcttggatttatgttggtgagacaaaagagaaaaatttcttgattaaaagcgttcacagtagtaagcaggacgtaaaaatatactttggcttacctgataaagcaacagtggatagtaatggggctgtgaatgcgcctctagatatttctgatgtcgaatatacaaaaggtcaagcctatatcggacaaggtacacaaattgaaaatctacttggttccgcacatagcgacactttaatcggtaatgccgcagacaataatatttacggcggagcgggtgatgatacattaattggcggggaaggtgaggatacttttgttttcaatgctagtttgaatggtaaggcagatgttattaccgatttcagtgctgaagataaaattgaattatccaaaacgatctttagtagtttaacaagtgcagataaagtgatagaacatattcaatatgattcatcaacagggaaattaagctacgatagtgatggaagcggaaaaggcaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgacgtcaagtcatcatggcccttacgagtagggctacacacgtgctacaatggtgcatacagagggcgacgaagccgcgaggtggagtgaatctcagaaagtgcatctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaactgaaagggggcgtttaccacggtatgattcatgactggggtgaagtcgtaacaaggtaaccgtaggggaacctgcggttggatcacctccttacctgaatgaagagatttgcaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaagagaacgagacatccttttgggtctgtagctcaggtggttagagcgcacccctgataagggtgaggtcggtggttcaagtccactcagacccaccactctaaacggtgaagagaaatctatactgaatagtgagtgaaacgaagaaagcgatgtgatgacattttggggatatagctcagctgggagagcgcctgccttgcacgcaggaggtcagcggttcgatcccgcttatctccaccaatcatcatatttaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcccaaagcgtaacggaggagcacgaaggtttgctaatcacggtcggacatcgtgaggttagtgcaatggtataagcaagcttaactgcgagacagacaagtcgagcaggtgcgaaagcaggtcatagtgatccggtggttctgaatggaagggccatcgctcaacggataaaaggtactccggggataacaggctgataccgcccaagagttcatatcgacggcggtgtttggcacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaactattttgtctattacaccgataattcaaatctcttgccttggcactgcattttgatagccaaactgtcgccacgcttcgtacaccacaacagcaacggaattagacaagttcatactacggctatctttacacatcgggatacggattttttgtgacattggtaaactatctaaaatcgctttcggtatcccacggctttcagggccgaacatcagaaaatcccccaattcgtactgcacatcgctatgattaggctcgcctttggtggttaaagcaaaaaggcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtttaggctttgctcgctcaagaaaatcatcaaagtctttatatttttgaatatcgacaaactcgtggtaatccagcccagagcggcgtaattttttatcatcccacgcaaagccaagtggctcaatcatatgcaaacggaaaccgcagtttgcacaaagacggataatattcccactattttgtgggatttcaggttcatataacacaatatctaacataatttattccgaatgtttcacaatccagcagttatgaatatgcggattacgctcaaaatccaacggtaatgttttgtgcgaaatgttttccgccgttaatcctaattcagccaagccgtcaaaatccattttaaagccacgtttgttgttcgagaatacaatcgtgccgtttgccgttaaaatgcgtttcaactgtttcatcaaggcaatatgatcacgttgtacgtcccaactgttttccattcgttttgaattagaaaaggtcggcggatcaacgaaaatcagttcaaaacgctcacggcaatccgctaaccattgcaagcaatctgcctgatgcaagcggtaatttcgtagtgaaatattgttcagctcaagattttgttccgcccagttgagataggtgtttgacatatctactgtcgtggtcgattttgctccatttaacgctgcgtgaaccgtcgctgaacccgtgtaggcaaacagatttaggaaggtttttcctttcgccatttcaccgaccatcttacgcgttaagcggtggtcaaggaacaagcctgtatcaaggtaatccgtcaagtttacccatagcttcgccccatattcattcacgaagaaatagtcgcctttattcgccagcttctcatactgattagtccctttttgacgttggcgaacttttaagactaacttattcgtttcaacaccagtgacatacaaggtcgcagataccgcatcaagcaagcgctggcgagctttgttttcatcaatatttttcggtgcggcatactcttgcaccacgatatgatcgccatatctatccaccgccaaattatattctggtaaatcggcatcgtataaacgataggcatcaagcccttgctgtttcgcccatttttcgatcttcttgatatttttggttaaacgattagcaaaatcaggggcaacttgtgcgttttggctaaattgcagattttcatcaagatctgaccgcttgtctgcattttcgctgatcaaatagttcttctgcacacactcaagcggtccattctttgccttaaattgacgagctgaacgcagacgtaagcagttcagtaattcaggttcgccactaaaaatggaggcattccaacctgcaaattgctgttttaaccgttgcccaaagacagagtacaacgcaattaacgctggggttgtacttagtcgttcaccataaggcggattacaaatcaccgtccccacctgctctgcaatcggatttttcaacgccgacacatcgccttgttgccactgaattaaatctgccacccctgcatttttcgcattctgtttagctttttgtagcactcggtgatcaaggtcaaagccgaagaacagcactttgcttccctccccctgctcgcggggggaggtgccgaaggcggaggggggtaggatttccccctctttcgcttcctgccaaacccttttccacagttcgatctgatgccccttccaactatcaaatccccaatggatacggttaatttgtggggctatattggcttgcatttgagccgcttcaatcaacaaagtccccgaaccacacatcggatcgacaagtggcgtgcctttttgccagcctgaacgcaacacaatcgccgccgccaaggtttcacgcaacggtgctttccctgtttcttcacgataaccacgcatatgcaaggcctcaccgcttaaatccaaagaaataatcaattcttcacggtttaaataggcgtgtaaacgaatatctggacggattttatccactgtcggacgagcaaaacctttacgctcaaaataatcgacaatgccgtctttcactcgcattgcaccgaattgtgtgttgcgaatttcacggtttgtgccgttaaaatccacgaaaaaggtatctcgcggatcgaaaatgctctgccagtcgtaagcaaccacagacgcatacaaatcgctgtcgctgaaaaatttcgtattgattaagggcaataaaatacgggaagccaagcgactatgtaataacgcttgatacgccccttttaaatcagtggtgaaatgcacgccgccttgagccactttgcactgtgcgcgcgtaatctgctcaagttcggtttttaacatttcttcaaagccacgcgctgcggtggcgaaataggttgtttgggtcattgttttaggtcaatggaaaaaagttgatggaattataactgaattgcgttagatctttaaaatagctgctgaattttaacaactaatttaactaatctttattagactctcgctgaatacaccttaaacttactcgacttcgctaacacttaatgtctacaaaatgccttatccaataaatcgggataaggtaaaaaagcattggcaacaatgcgtagctcaccaccacggttaagatgttgtttagcttgggcaatcaactcttctaccgcacgatatgccgtatctacaccgtcgtggaaaggtggatttgacacaatcagatcaaaacgcccgccaatatgggaaaagacatcacttgctaccacatcaccttcaagctgattttccgccagtgttcgcttacttgattccaatgccattgcgtgaatatctgacatcgtcagcttgattttcgggaattgctgttttaagcacgctccaatcaccccagccccacagccaagatctaacaccttccctttcaatccatcggctttattgaaggtggaaagcaacaatttagaaccattatccagttctgccgagctaaacactgcaggcaaagcaaacacatcaagatcgcccaaatggtaagatttccagaattttttgctatcaaaagtaggcacattttccagcctaaaatggtacaacccataacgacgagccgagtcaatcttggctatctcaccaaacggctcaagtaaattttccactgaacgcacgccgacacggttttcacctaccaccaataattcttgaccaactgacgcagtcgccagccattgtaacaactgaaattgacactcttgcttattcttcgtccagtaaaagactgctaagtctgcttgctgataacattccaagccaaattccacgttattataatggcgagcataatcaaaatagctactgaacaccgccacagactttgccatcggctgaatgagtcccgaaaaatcatcacgcacatcgccaaataacaatacatttttttgctcaaagacgctcagatggcgttcaagcacttcactttcgattgataacataaatttccaaatttaatgcaaaataatttctgcattttaccgatttttgctactattccccaactttttatgaggaaaaatgatgaatcgccgagatctgcttctaacagaaatgaatataccccaatggatacttgttaaaccgcaagtactcaaaggcgatgcacaaattcgcttggcggacaatataaagctggtagttatttgcgaagaagatcaccaacagactgggttatttcaagatgttttacgagccttgcaattaaatcacgagcaatatcaatggattagccttgagcaagcaatgcgtctgcaattcgatcatcaaccgattttctggctgattcaacctgaagaacaagcggtacaatttacaaaaaaatttgcaaatcagaccgcttggcagtgtgagtcttggcaaatgctttcccaagctacacaaaagcgagagctttggcaacagatgcaactgttttgtaaagatatggcagaataaaatgaaaacattagttaagtagattacagttttaggaatattattcagtttctttattgcctgtatttatcttttcaaaccaccttatttctacgcttatgcacgttggcttcctactttactgcaaggaacaccaacagaacaaagcttacccaatcctgttcccaatcaacggtttgcagatacttggcacggaatgcgaagtggcggacaaaacaaactgggtggaaaagtggtcagcgtaatgacgggatggacggtacattactatgctcacttggaagaatatggcgatataaaacgtcatcaatggattgagcaaggagctgtgattggcactgttggtgatagtggtaacgccaaaggtactccacctcatctgcattacggtatttatacaccgactggggctgttaatccttatcctttaattaaacaataaatagtttttttatatgaaaaaatttgctattcatcttttatttgcaatatttccgttgccaccgcttgtagctctatagaaacagccaagacaacgctaaacaacactgaaaaatgggcagcagaaatagatagagaggcaaatttctatcgtatcaacaataagttattggtaagcttgtgaaaaagtgatacccaataacacataattcattacatcactaatgttttaaggatattctgtgatagaacctattttagaaaacgacttcgaccgcctttttgagatcgaacaacaagcccatttagtgccttgggcgaaaggaacgctgttaaatagtcaaggcgaacgttatttgaatttgaaattatccgttgaaaatcatattgttgcctttgtgatctgtcagtttttgcttgatgaagcgacactgtttaatatcacagtcgatcctgcctatcaaggaaaaggctttggtaagcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcaactgttgcaagcgttgatcgctcagcttcaacaaaagcagatcacgacattatggcttgaagtgcgagcttcaaacacgactgcacaaaaactttactactcactaggctttaatgaagtgacggtgcgaaaaaattactaccctacccaagacggtgggcgagagaatgcggtggtgatggcgttatatatgtaatgagaaatatatctctcgttaagtgacaaaaatggattttgtgtaacttataactatcacaaaatcctttttctgtttataatgcgtgatattttttaccgtagagaatttttatgcaaatcgaaccgcttatacttcaagcctacattgctgatcgttggcaggatattgctattttgacctttcaggctgattatagtctcaatgattttagctatctccatgatttaacagaaattttaagtgataatgataaggcagtttcatttaactaccctgtggaattttttccgcatcgcagtgtatcgggctggtttgcatttttagatgatatagtcccttctggggcaagccggcgttattggttgcaaaaacttgatattgctcatttgccgacagctcaacaaaactatttgttattaaaacaaggtacgattgcacctgtcgggcatttacgagtgaagcaagcggtcagttcttttatcgaaaatgaaccccctcgcttatttgaaatagatgatgttatcaatcgccaagctgattttttggaatatgctaatcagcgtggggcaatggctggcggtgccacaggggctggcggtgaagcaccgaaattattgctacgccaaacagccactcggcaagtttggattgataacctacaacaaggtgcctcttctgacgatttctatttagtcaagtttccgcgtgggaaacgtagtgtaatagattgcgatatattgagagctgaatttcactattatcacgaattagcctcaatgggttttgacacgattgatacgacaaaaatgcgattggaagaaggcgaacgttacccgtcgttgtggttacctcgttttgatgtttatcgtaatgaacaggggaaaatggctcgttatgccgttgaatctgtttatgctatgttagaaaaaggggctggctctttgctggatcacgaaaaggttattcgtcagttgattgctaaaattgaaacctctcatttggttgaaacaggaatgttttttgataaacaagcttttgtgatcgagtgggtaaggcgagatttattgaatatcgcctttggaaatagcgataatcacgggcgaaatacggctttcttacgcaatcaaaatcgtatttggcttgctccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatgattttgccccaatgaaagcagatcctgaaggtattcctcgcacgacaatgtgggatagtaaaggtcaccctgcattagaattaggcggtgaatatcgttttgatctgattgcagaacagcttgatgatttatgtccagccgacaagttattggatgctttgcgtcaaacggctcaacagcttgtcggacttaaagcacgtttagaagcaaggggcgttccaacggcgattttgacgtatccttcaatcagtttggactatttacctgaaaaattaaaacgttggcaattattatcataatggaagagatcaaacaggcgagagcctctaaaagtaaaaaaacgttagatatttatcagagagcgactgtgcgagacgaaattgctcgtaagctattgctcaatgagatgagtttagggcaggcgttgaaatatctacgtttacatctactggcaatgaaacaagagcgttatgcggagattgtcaaagtttctcgcaaaacgttatctgatttagaaaatgataagggaaattacagtattgatattatcaatcaggtgttacgcccctttgaattacaactaggtgttgtgccaatgaacaaaacactactcagacaagttttaaacgaacaagcggtctgattttcttaaaaattaacaagagaacaaaatgaacgaattaaccacctttgaagaattagatttaagccctgagctgttgcaagcattggaaaaaaaaggctataaacgcccaacggctattcagcaagaaaccattccgcctgcaatggaagggcgagatgtgttgggttcagccccgacaggcacaggaaaaaccgctgcatttttattgccagcgttacaacatttgctcgatcacccacgccgtaaacctggtccaccacgtattttaattttaacgccaacccgtgaattagcgatgcaagtggcagaacaagcggaagagttgacacaatttaccagcttgaaaattgccactattacaggcggtgttgcttatcaaaaccacggcgaagtgtttaacaccaatcaagatcttgtggtggcgacacctgggcgtttgcaacagtatattcaagaagaaaattttgattgccgttctgtcgagattttaatttttgatgaagcggatcgtatgttgcaaatggggttcgggcaagatgccgaaaaaattgcagcggaaacccgttggcgtaaatatacttggctcttttctgccaccttggaaggcgaattgttagtggattttgctgaacgcattttaaatgatcccgttcagattgacgcagagccaagtcgccgtgagcgtaagaaaattcagcagtggtattatcacgctgataatcttgaacataaaaccaaattacttgcccgtttgataagtgaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataagtgaatttgagattgagcgaagcattgtgtttgttcgtcgccgtgaaagtgtgcgagagctaagcgaaaccttgcgtaaacgtggtattcgttcgacttatctagaaggcgaaatggcacagacacaacgtaatcaagcgattgctcgcttaaaagacggcgtggtaaatgtgttggtggcaacggatgtggctgctcgtgggattgatattgatgatgtcgattttgtgattaactttgacctgccatatagtgcggatacttatctacaccgtatcgggcgtacagctcgtgcaggcaagaaaggttcagccgtctcattagtcgaagctcacgattataaactgcttggcaaaattaaacgttatacggaagagccgttaaaaccacgtattattgaaggcttagtaccacgcaccaaagccccaaaagatggtgaggtgaatacggtgtcgaaaaaagagaaagcgcggattaagaaaaagaaagaagagaaaaaagagagtttgaagaaaaaagtgaaagttcgccacaaagataccaagaatattggtaaacggagaaagccgacaggggagcagggcgaaagctaaaaacaagcgggtagatctcacaccatttttagtaaatatcaaatattttcttaaaataatttgattgtagtttcatagtatattattgagactattataactttcaaatttgaggattgtatgaaaaaactcacaaaactgctatcccttactctgttatttgcccttgctggttgtcattctgtactggatgctccgactgaaatcactcaacctagtgtgacaattccacataatgatgcaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgcaaaatggcaacaacatcttgcacaattaacgcaaatcaaagcctattcggcgaaagggcaatttggctatatttcccctgaggaacgtttttcttcccattttgattggcaatataaaaccccgacgaactttgggctaacgatgtcctcaaatttatcaagcaaatcattgaaattacagcgtaatgcttatggaatgacgatttctgacagcgaggggcgttctcgtaccgaagcagatgtggctatgttaatggaagaaattatcggcgtttcgttcccgatagatcaatttgcctattgggtgaaggggcagcctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgcctattgggtgaaggggcagcctgagcaacagtcaaactatattgtcaatgaaaaacgccagttggctcaatttgattatgcggtcaatgggacgttgtggaaagttcgttttgtggaatatcacgaagatcgcccgccaaatttgcctaagttgattgtgttggaaaatggttctcaaaccttgaaaattcgtattgatcattgggcgtactaatatggctacttttacttttccaagtcctgcgaaacttaatctttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaacttaatctttttttgtatattacaggtaagcggtctgatggctatcacgaattgcaaacgctatttcagtttttggattttggtgatgatattgagattgaacttcgccaagatccaaccatttgcttaaccaagcagattgatggtgtggctgttgagcaaaatctgatttatcgtgctgcaaaattgttgcaagaaaaaaccgcttgctcgttaggggcgaacattggcgtaaccaaacgcttgccgatgggcggaggtgttgggggcggttcatcaaatgcggcgacggtgttagttgcgttgaatgaactttggcaaacagggctttcccttgagcaacttgctgaaatgggattaaccttgggggcagatgtgccgatttttgtgcgaggcattgcggcttttgctgagggggtgggtgagaaattaacgccttgtcagccgaaagagaagtggtatttggtgttaaagcccgacgaggcgattgcaacagcttcgatttttaagcaccccgatttaactcgtgatacgccaaaacgtactttaacggagctacttgatgcccctttcgcaaacgattgcgaaaaaattgtcagagatctgtattcaaaggttgatgatctactaaattggttggtacaatacgcaccgtctcggctaacaggcactggtgcttgtgtatttgctgaatttgattgtgaagatgaggctcgccgtgtgtttgcgttaaaacctgaaaatgttgatggctttgtggcacaaggcagaaatgtttcccttttacatcaaacgctcaatttatatccttaaaaatctacatctagaggtttatccaaaatgcctgatattaaactcttcgctggaaacgctactcctgaattagcaaaacgaattgctgaacgtctttatatttctctcggtgatgcaacagtaggtcgtttcagcgatggtgagatccaagtacagatcaatgaaaatgtgcgtggaggggacatttttattgtgcaatcaacctgtgcaccaacgaatgataatttgatggagttgatcgtaatggttgatgcacttcgtcgtgcttcggcaggtcgtattaccgccgtaattccttactttggttatgctcgtcaagatcgtcgtgttcgttctgcgcgtgtgccgattaccgctaaagtagtggctgatttcctttcaagtgtgggggtggatcgggtattaacttgcgatctacacgcagaacagatccaaggtttctttgatgtgcctgtggataacgtattcggttcaccagtattgatcgaagatattttaaagaaaactgatctggttaatcctatcgtggtttcgcctgatattggcggtgtggtgcgtgcgagagctattgcgaaattattaaatgatgcagatatggcaattatcgacaaacgtcgtccgaaagcgaatgtggctcaagtaatgcacattatcggtgatgtggcggatcgtgattgtatcttagttgatgatatgatcgacacgggcggcacattagtcaaagcagcagaagcattaaaagagcgtggggctcgtcgtgtatttgcttatgcaacacacgctgttttctccggcagtgcggcgaaaaacttagcgaatgatgcgcttgatgaagtgattgtgacagacactattccactttcggctgagatccgtgcattaaataaagtgcgtgtattaacgttatcaggaatgttggcagaagctattcgtcgtatcagcaacgaagagtctatttctgcaatgttcagccattaatcaaaagcccaatcgaaagattgggtttttgatttctaatgtatggcattgatttttagaaagcaaaattaattcttcccccataaatgggggaagtcccttcgtgaagcgaaggggatggggcggaaaaggatatttaattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgggggaagaattttctttctttccctcaagcgagggaagaattgtaattttatattgatacaaatgatgtacccacttatcaaaaaagcactatttaatcttgatgcggaaaacgcccatcaacttgcaattcaatccttaaaattattcggtaaaaccctgttttctttagcttgttcacttcccgacaacccgaccgaagtaatggggctgcgtttcaaaaaccctatcggtttagccgcaggggcggataaaaatggcgaggcgattgatggctttgctaaattggggttcggttttattgaggtcggcactgtcacccctgttgcacaagacggcaatccccgtccacgacagttccgcattcttgaagccgaaggcattatcaaccgcaacggatttaataatcttggggttgatgtgctgattgaaaatgtaaaaaaggcaaaatataacggtattcttgggattaatattggaaaaaatgcgacgacccctatcgaacatagcttggacgattatcaaatttgcttacgcaaagtctatccacacgccagttatgtgacggtcaatatctcgtcgccgaataccaaaaatctacgttctttacaatacggcgaagcacttgacgatctgttacgctcacttaaagccgaacaagcccaactttcgcaaaaatttggggtttataaaccgcttgtcttgaagatcgcccccgatctcactgccgaagaaattgcttctgttgcggacagccttgtccatcaccaaattgacgctgtgattgccggcaacactacactttcacgagatagcgtcgcaggcttgccttttgcggatcagcaaggggggctaagtggtaagccgttgaatgctctaagtactcaacttatttcgcaactttctcaagaattaaacggcaaactgcctattatcggcagtggcggtattcattcggtgcaatcagggcaagaaaaaatcaacgcgggggcaagtttattgcaactctattctgcgatgatttatcaaggacccgatttagttcggcagttggttaggaaaatttctatttagggatggttttacaaacttccaagagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgggggaagaattttaaattcttcccctatttatgggggatgtatcctcgcttgcgggggaagaattttaaattcctcccctatttatgggggatgtctcctcgcttgcgggggaaggattttaaattcttcccccatttatgggggaagtccccgagcttgcgagggggatgggggctagcgaggggaatacacaccagctaaacaatactcacatatcgatcaacatcaggaataaagtctgcttctttgctgtatccaactgcaatggtatattcatagctacctgagccaatagcggtaacattcgtatttccttttacaactgtcgcggcaatagaaatcactcctgatggcacctgtagagtaacaccatcatccaccactactaaggatatttgttctgccctatgggcatcagtcttaatcgattgacgggtaccttccgtcatttcatattcccaactaaagttataatatctaacaatccctgatttcttctaataacaagttgttcatcaacaattttagtgaaaaagactttaaggggttctcctgatttatcaacaagatgataagttttacctgaagccgcagaaagagttttattagtgagtgataaaggaatagaggagcgcatagttaaaccttaatttgtcaaagaaaaaggaattccgaaaccgtttgccaaaatggatatattgtatttttttaaggggggtagtcaagcggaacaatgtgtagaaaggcaatcaggaggtttagagaagttttttcggtgtatagactaaagtttttatggggctaataattggggggaaatcttaatgttttaaggctaagttagattaattgatttgataatctaacgtagcactttgcatttttaatatgttatcttgtcccatacacaacgatagttttaccatgtgcagaaattaacccttcatcctcaagcattttcaaaatacggcctacagtttctcgtgagcaaccaaccatttgaccaatttcttggcgagtaattttaatctgcataccctgagggtgagtcatcgcatcaggcattttagctaaattcatcaatgtttgagcaatacggcctgttacatcaaggaatgcaaggttactaacctgtcttgatgtcattcgtaaacggcgagccatctgagctgagagatacattaagatatcaggatttagatgaactaattgcttgaattttttataagaaatttcagcaatttcacagttacctttagttcttacccaagcagtgcgaggctgagccttttcttcaaaaaggctgatttcaccgacaaattcgccttggcctaaattggttaataacatctccttgccttcttcatccttgataaagacagacacagctccgctgacaatataaaacagtgattcagcatcttcacctgcgtgaattaaagtatattttgctggataacgatgaatatgacagtgagttaaaaaccattccaccgcaggatcgtgaatggatggtaatgggctgacatcttcaagctgtgcggttgagattgaaacatcttgcatagaaacctctataaatcatttatagttgatatagcttaatactacgtcaagaattttagcataaatttacaaattccctaagaaagattttttatctttaatatcaatgctttcgtgcaattctgaccaaacaattacaactttatcggcttttaactgagctaataaacgctctcgtttttctgcgagcgtgagttctcgctccccataatctgttccttctcttaaaataaaagaatctaaaacattatatagggtgctttcttcaagttcttgccaagggataatcatctttttcctagtagaacaatggcttaatcagttgccactgtttttcaaaatgttgatgttgattaaagccaaaatttgagcgaacaaggcgtaaaaattgcccttcacagaaattcaccaagtaaccagccaatgctcgttcatcagcaaaagccctgccctcacgcaatttacgcatttgcaataaattcataaattgcagttctaatccttcaaagaattttgcgacacgagctttgagtaactcatcttcaaacattaatgcatgtcctgttagaatgcgtgtcacccctgggttcttttgtgcaaattctaagatagtttgtaaaatcgcttttactgccaattcggtattttcttggcgtttacttgcattgatatagctcgttaatgtcatctcaatccgttcaatcaaagcctcaaacatctttgttttacttgggaagtaacgatataacgccccttcagatacgccgaccgcttttgataatctttcggtcgtaacacgttgcataccttcttccgagttaagtagcccgattaagacttctagcacttgttgctggcgttcttttaccgattttttcggcattttgataacaggttctgtcattttcaatcctattgcttacctgaatgaccaaatccaccctcaccacgatctgtcgcagtaaactcttctacaatgttaaattgtgcttgcaccactgggacaaacacgagctgtgcgatacgatcacccacttcaacagtaaacggcttatcgctacggttccatagggaaaccattaatggaccttgataatcgctgtcgattaagccaatcaagttacccaatacgatcccgtttttatgtccaagccctgagcgaggcaaaatcaccgcggctaagtttggatcagcgatataaaccgaaatccccgttggaattaacactgtatgcccagcttctacggttaaaggttgctcaatcaatgcacgtaaatctaaccctgctgaacctgttgttgcataggttggcaaaggaaattctgtgccgatacgtttatctaaaatttttaagtcgatttgtttcattattcttccttttacaaatttccaactaaagctgaccgcttgttaccaagatttcacaaggcaaccaaccgatttctttgcctttactcactaatgcccattgataatgaagctccagtaattcaacaatatctcctttcactaccgccaattccgttgggttgtaatcggtcactaaatgattcgctcggacaaaatgttcaggcacataagtgtgatagccctcaatttcacaagcataccaattcggatatttccgacaaggtgtaagcgctttgatttcagtgcctttcacaaaagtaggaaaaataccttcttcaatggtataagatgtagtgacctgtagtttcatattcgttccttagagatggcggtaatgttctacaatctcatccaccagcttttccgccaatttccctttctctgcaagctgtaagatcttctcgccattttgccaaaagagatgaagtgtattttgatcttgcccgaacacctgtccgccagatacatcattggcacagattaaatccaaatttttacgttgtaacttatctttcgcataatcagccacattttgcgtttccgcagcaaatcccaccacgaaagggcgattttgagtaagatgggctactgttgcaataatatcgggatttttcaccagttttaaagtaagttcatcattatcaccagttttcttaatcttctgttctgctacctgttccactcggtaatctgccaccgccgcacagccgataaaaatcgcatttttctgtactaaattgaccgcttgttctgccatttgttgtgccgaaatcacatcaatacggctaacattttgcggtgtagccaaattgacagggcctgcgatcaaggtaacttttgccccacgtttagcaaaggcttccgctatcgcaaagcccattttacctgagctgtgattactgatataacgcacaggatcgatcgcttcacgcgttggccctgcggtaatcaccacgctcaaatcagcaagatcttgtgattgcgtaaaatgatcttcaatcgcttgaaaaatctcactcggctcagacattctgcctttgcctatatcaccacaggcttgaaagccagcgttaggtccaatgatcgaaacaccttgctcagtcaaactttgcaaattttcctgcacaatcgaccgcttgtacatctgctggttcattgctggtgcaagcaaaattggcgaagcggtcgcaaggcaaatggtcgaaagcagatcattgcccattccgatacgcaaccgagcaataaaatctgctgttgcaggggcaatcaccactaaatcagcccatttcgccaattcaatatgccccatcgctaattccgcttggggatcgagtaaagaggttgaaaccgcattacctgaaatggcttgtaatgtcagcggtgtgacaaaggcttctgccgcaggggtcattgccactcgcacttctgctcctgccgtttttaataaacgaattagctcaatggttttgtatgccgcaatgccaccagtaataccgataaggatttttttatcttttaacataacgaatcatctttatgatgggttttctacttgctattttacgcaaataggtactcactcacaacgccctatttttgcgatctttgtcgaaaaaagagaaaaagccttttgaatcaaggtgagaagatttttatgctgtttgcactttttaactaattgaacaaaaaatatgaatgaaagttctagtgaattaatgccaagagaaaaattgctgaaatttggtgctgaagccttaagtgatgctgagctattggcaatctttttacgtacaggaattaaagggatacccgtgatggatctatcggaaagcgtactcactgcctttggttcattacggggattgctgtcagcaacattagaagatttctgtaaaatcaaaggattaggacaaattcagtatattcaacttcaggcaaccaaagagatgacgaaacgctatttatcgcaacaaatgaaagtaaatgaaatggtagatagcccctatttagccgtaatgtattttcaatcggaattggaatcttgggagcgagaagtatttatggtgatctttttagataaccaaaataggttgatcaaaacagaaaaaatgttttacggtacgatcaaccaagcctcagttcaccctcgtgaaatcattaaagaagccttgaagtgtaatgccgccgccattttagttgcacataaccacccatctggcaactgcaatccaagtgaggcagatcggtttttgactcgaaaaatagaaatggcgtgtgatttagtcgatattcgctttgttgatcatattattgttggcaaaggtgactatttttcgttcgaagaagaaaagtttgaacaggaaaattacgaatttcccccttgtttagatgaactaaagcaagtataattcgcagtctttaaaatagtctgtgggtcgggtgtatgtacctgacgaggtcgtcagattgagttgagcctttctgatcgcccgaaccatttagcttaagcttaagtaatatcggagaattgaaaatgtctagagtctgtcaagtaacaggcaagcgtccagtagttggtaacaaccgctcacacgcaatgaatgcgactaaacgtcgttttcttccaaaccttcacactcaccgtttctgggttgagagcgaaaaccgtttcgtaactttacgcttaacagcgaaaggtatgcgtattattgataaaaaaggcatcgatgcagtattagctgaaatccgtgctcgtggcgaaaaaatctaaggagctaacaaatggcagctaaaggtaatcgcgagaagatcaaattagtttctactgctgaaactggtcacttctacacaacaacaaaaaacaaacgtaatatgccagaaaaaatggaaatcaaaaaatttgatccagttgtgcgtaaacacgttgtttataaagaagcaaaaatcaaataatttgcttacttatattaagaacccagcgaaagctgggttttttatttctattattttctcggtattctattaaattttatttgaaatgataataattcttatttataattatttctgagtgttttacttggtttttacctaataggagttttaatgtcgctatttgggcaattcagaaagttactttaacaacagacgttcgctacgaccatttcagcttaaatacattaggcaaacaaatagtactaaaattcatgcttctgaggggaaagtgaatcctagcttgaatgtaatttgggatatcacctcaaacttggcattgaagacaaaattgaattatgctagccgttccccagcgttagccacagctaatactataacagataaccgtgaaaatttagcacaagttcgtggaaggagagatgttgatagtaatctaaaacctgaacaatcacgtctagcagaagtcggttttgaatggaaacattcaggagctagacttgtagcaagcctttttgatgaaaaagtaacgaattattactccggagttactgctcctactataacaaatcttggcaatcttagaactagaggatatgatgctgaagcatcttatgaaattgcagggctaaaagttggtgttggagcaagttattcaagagctacccctgaaggctttaaactttcgggggatgttttggatattgtacctaaaggtcgccaatggaaaacaaccctttcctatacatttgagaatccaaatctagagataggatatagagggcgttatgcagaagctaaaacctttgtgattacgactagaagtggcgatgaaagaattcgtaaagctggttacggagtacacgatatttatgctaatctgagattactcaaagatgatttaagtctcgactttgctattaataatattggaaataaacgatatcaaagtcatagccaacgtttacattcacatataaaccctggccgtcagtacattattggggcaaattatagattctaattttttaataatgtgatctaagcggtaggatttacgaatcttgccgcttttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagactttcttaagatttctctgttttaatacactcaacaaagcaatagtgctttcactaataaacactcggagcaatttatgaaaaaacttactttactttcagcattaattttatcaacagttagcctttcagcgtttgcggacaaaggttattatcaaaatggtggctttaataatagccagcaagcgattactccagcaagccaagtttcttcaatgagcgatgatcaatatgttgtcttgcaaggcaagttggttaaacaattggataaagacaatttcacattccgtgatgcaagcggtgagattactgttgatattgatgacgaggcttggagagggttaaatgttactccaaatgatgaaatcagactttatggtgaaattgataaatcattggtcggtacagaagttgatgttcatcgtgttgaaaaagcaaattaatgcgataatgggaaagtggctgtaaatgccacttttcttttttgaaattgggaggttgagatgcgtattttattagttgaagacgatccgttgatcggtgaagggctaaaacttggtttgagtaaatctggctttagtgtggactggtttgccgatggcagatctggcttagaggcgttaagttctgctccttatgatgccgttgttctcgatcttaccttgcctaaaatggacggacttgaggtgttacaaagttggcgacgggcaaatcaagatgtgccagtgctaattttgactgcaagagatacccttgatgaacgtatcactgggctacaacgtggtgcagatgattatctctgtaaaccttttgctctcgcagaagttgtagctcgtttacaagctttgatccgccgtcgttatgggcataccaaccccgtgattgaacatagtttagttaaattcgatccaaaccaacgcaaagtgtttcttcgggagcaagaagtcaccctaaccacacgagagtacaatttacttgagctatttatgcacaataaagagcgtgttctcacccgttcttttattgaagagaaactctatacttgggacgatgaagtcagtagcaacgcccttgaagtccatatctacaatttacgccaaaaactcggaaaacagtttattcgtaccgtacacggtgttggctatgccttaggaaaaaacgatgaagttgcttaaaaataccagtttacgttttcgcttgatgatcgtcatttcttgcacagcgttgcttatttggcttatatccactgcagtggcgtgggtgcaagttcgtcacgaagttgatgaagtgtttgatgctcaacaagtgttatttgctcaacgtttggcttcttcagatttacgcacattattgatggaacgtaagccacaacgggcttttaacgtcgaacatcataagaaatctttaaaaaagaccactttcgatgatgacgctctggcatttgctatctttaatgctcaaggggaaaggatattaagtgacgggcataatggtgcaaactttccatttaaaagagccagtggttttaccaaatcccgacttaatcacgaagatgacgatgagtggcgaattttttggttaccgattagtgatcgtttttttgtggcggtcggtcaagagcaagattatcgagatgatctggttcaaggaatggtgtttagccaaatgtggatctggtttgctagtttaccgttattattgggattgattgtgtgggttattaagcgtgaattattgacattgcaacgtgtcggggagcaagttcaacagcgaacacctgacgataacagtccgctttcgacagcagtgccgaaagagattttaccagtagttactagcttaaatcagttttttgataaaacatcaactgtgttattaagagagcgtcgctttacctctgacgctgctcacgagttacgcagtccgttagctgcattgaaaattcaaacggaaattgcacaattagctggagatgataccgctttacgcgagaaagccttgtataatcttactcaaggaattaatcgtgcaacacaattaattgagcaactgcttacgctatcccgtttagataacttaacggaattggaaggtgtagaagatattcattgggagaaattaattccatcattggtgggagagctttatttccaagctcaaaaacgagagatggaaattgagtttgaacaaaaaggcgtacctgcggttaaacaaggtcagccgttacttctttccttgatgttacgaaatctggtagataatgcaatgaaatattgccctcaaggtacgaccattcgtattacattagagtcgcaatgtattatcgtggaagataatggtggtggtgttgatgaggcagatcttgctaaactggggcagcgtttttaccgtcctgctgggcagaatgaaaaagggagcggtttaggcttgtcgattgtaaggcgtattgcggagttgcatggttactatatttcgatggataatgtatacaatgtgaagggtggaaaagggcttagagctattattaatttatcgggactgtgccgtcaaactccgtcctgaaggatcgagatataaggcgcaaacggtgtgagccgtttcaaacctaactaagcaggtgtttgttgttgctcgatgtattggcgaataatcgaaatgggcgcattaccgcggcaggcagcaaatccgcagaattaaacagttctgcggatctgctcgttttgtgtttaatcgggcgttgacttggtaaaatgagcaatacgaagtagcctattgagaacaataggagctagtaggaattctcgccttttatagcggagagtacgtcaatcaatatctcctagactatattaacaaatttttctcttcccccttgaaatctccagatagagatccaataattactttctattactatagttatttctaattacaataatgaggagttattcaatgaaaattcgtccgttacacgacaaagtaattttaaaacgtgaagaaatcgaaactaaatctgcaggtggtatcgttttaactggctctgcggcaactaaatctactcgaggtactgtgattgctgttggcaatggccgtactttagataatggcactgtgttaccattaaatgtgaaagtcggtgatgtggtgattttcaatgaatatggtgtgaaagaagaaaaaattgacggtgaaaccgtattaattctttctgaagacaatattttggcaattgttgaataactgtgtagggacacactgcgtgtgtccaactacaacaagcggttaaatcattcaatatttttacaaattaatcacggacacacgcagtgtgtccctacaaggaataaaaaatggcagcaaaagacgtaaaatttggtaatgacgctcgtgtaaaaatgttaaagggcgtgaatgtattagcagatgcagtaaaagtaactttaggcccgaaaggtcgtaacgtagtattagacaaagcctttggcgcaccaaccatcactaaagacggtgtatccgttgctcgtgaaatcgaattagaagataaattcgagaatatgggtgcgcaaatggttaaagaagtggcatctaaagcaaatgatgcagcaggtgacggtacaactactgcaactgtacttgctcaagctatcgtaaacgaaggtttaaaagcggttgcagcaggtatgaacccgatggatttaaaacgaggtatcgacaaagcggtagcagcagttgttgaagagttaaaatcgctttctaaaccgtgtgaaacgtcaaaagagattgaacaagttggtacgatttctgcaaactcagacagtactgtgggtaaattaattgctcaagcaatggaaaaagtgggtaaagaaggtgtaatcactgttgaagacggcactggcttagaagatgcgttagatgtggttgaaggtatgcaattcgaccgtggttacttatcgccatatttcatcaataaaccagaagccggcacagtagaattagaaaatccatacattcttttagtggataagaaaatttcaaatatccgtgaaattctgccagtattagaagcagtagcaaaagcgggcaaaccattattgattgtcgcagaagatatcgaaggcgaagcgttagcaaccttagttgtgaacacaatgcgtggtatcgtgaaagtggctgcggttaaagcgccaggctttggtgatcgccgtaaagcgatgttacaagacattgcgattttaaccgcaggtacggtaatctctgaagagatcggtatggaacttgaaaaagcgactatcgaagagttaggtcaagcaaaacgtgtggtgatttcaaaagacaacaccaccatcattgacggtgtcggcgatgaagcacaaatcaaagggcgtgtggcacaaattcgccaacaaatcgaagattcaacctcagactatgacaaagagaaactccaagagcgtgtggctaaattagctggcggtgttgcggtaatcaaagtcggtgcagcaactgaagttgaaatgaaagagaaaaaagaccgtgtggatgatgcccttcatgcaacccgtgcggctgtggaagaaggtatcgttgcaggcggtggcgtggcattagtgcgtgcagcaagcaaagtggctgatgtagtgaaaggtgataacgaagaacaaaacgtaggtattcgtttagcacttcgtgcaatggaagcaccacttcgccagatcgtgacaaacgcaggtgaagaagcgtctgttgttgctcgtaacgtaaaagatggcaatggcaactacggctataatgcagcaaccgaacaatacggcgatatgttagaaatgggtatcttagatccaaccaaagtaactcgttctgcattacaatttgcagcctctatcgcaggtttaatgattacgactgaatgtatggtgacagacctaccaaaagaagaaaaagctgacctaggcgctggaatgggcggtatgggtggaatgggcggaatgatgtaattgctaagcagaccttatttgagtagtagagctaaacccgtatgggtttagcttttttcttttcaagaatgagtggatgattccattttgtgatctagttcatatcttctttgcattatttacgctatactccatattatttcaactttttgaaaggacactccaaatgagccaaaaatttgagttaaatgatcaccctcaccgccgttataaccccttgaaagatgagtggattttagtttctccacatagagcgaaacgtccgtggagtggccaagtggataaagcggcggttgaacagctaccgagttatgatgaaaagtgctttctctgtccgaccaatacccgtgtttcaggcgatgtaaaccctgattatcaaggcacttatgtatttgccaacgattttgccgctttgatgcaagatacgccagatgctccgccatctgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccgttgtttaaaattcaaggggtacgtggtttagctagggtgatttgtttttcacctgatcacagtaaaacgctccccgaattgcctgtggaaaaaattcgtggtgtggtcgatacttggaatgctcaattagaagagctaggtaaagattacttgtgggttcaagcctttgaaaataaaggggcgatgatgggttgttcacaaccacacccacacgggcaaatttgggcgaactcgtttttaccgaatgaaattgcaaccaaggataaaaatttgcgtcgttactatgaacaacacggctcaaatttattggtagattatgctcaagcagagctaaaagatggcacacgaactgttacagaaacagaacattggcttgctgttgtgccatattgggcggcgtggccttatgaaaccattttgatgccaaaacgccatatcaaacgaatgagcgaattgagcgaagcagaaaaagatgacttagcccttgcgattaaaaagcttacttgtcgttatgataacttatttgaatgtgctttcccttattcaatgggctggcattttgctccgttctttaaagatgggcaagatattgaacattggcaacttcacgcctatttctatccgcctctgttacgttcggcaacggtgcggaaatttatggtcggctatgaaatgttagctgaagcacaacgggatttaaccccagagcaagccgctgaaaaattaagggcggtgagtgaagagatgcattataagcaaagataatggtaggggcgggtcgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccggcgataaaggttacagtcccacccattttgataagatatggttcataatgaatagaattagattgaccactgcctctcttactgacatccagtttccagcctgcattatttacagcattgactacagtatcaatagttgcaactccttgcttccccattaacaatttgccatcagtgttaaagtgaaacgtacctggttcagcggcattatcaatttttcgtttaatatcgtcggttaatttaaccgtaatcgtatcgccgctagcgtgggaagtaagaccatctgcgcctgttactttgagcgtaccatcccataaaccaactttaggttgttcatcattggaatctccaccaattttcattgtgagcgatttaagctgcgccacgtttactgcatcagttaaatctgtacctgccgcaacgttgacgatttggcgtttgattgtattattacccacagaattacccacagaaactgcaccgataagaaagtcatcagtacctttaggatgaccgtcaggactgtcaccaacacgttctgttgatttaaaaccattgttaacagtacttgcatctgttattacagaatgggattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttacttggttgttggtagttgcccgttcacccacagcgacagaacctgtgccatatgcagtagctagatagcctaaagatgccgaatgactgcccgctacagaactgctaccgacagccacaccatagtcgccatttgaagcacttttcgcaccgattgctacaccttctatatgggttgcttttgagactggaccgactacaactgatccatttccatctgcgattgattttccaccaattgcaatggcagcatttccttttgccgtggtggtagaaaatcctgctacagtgccatattcagtcgtatttaaatcatcgccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtaagagattgtgccccagttgcactagccaatgcacctattgcaactgtttgtccatttaacgcattggctcctttgcctaaggcgatagattgattgtctttagaaatactcgaatgacctatagcaaggccagaatctccatgtacaacagaatgtgcaccaaccacaacagagccctctttttttgcttctgagttataacctatcgcaatagtagtcctattttcagcttttgagttctggccaataccaatagcaccatacccaaccctactaccttgaccaataccaatagaaccagcgtcacctcctagagaccctagactagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttaattgttatccacacaactttgtgaataccgaattatctgtgggaaagggttatattttttgctaactagatgacgctactgttaagacactgccactttagttaagggaattaataattggaaggaataatactcaaatgctaaatgaggccccacatccacaagtagaacttgcatttggattttgcacaacaaaacgtgagccttccaacccttcaacatagtctatagtagctccaattagatattggagactcattggatcgataactaaagctacatctaaattttcaatggttaaatcgccctcattaagtttatcatcaaaagtaaacccatactgaaacccactacagccgccacctgtaatataaacacgtagacggagctctgggttttcctcgccttcaatcaagaatttaactttttttgcagcagcatctgtaaaaataagaggcactaagatatcactcattatttgtcctaaatcaaaacttgtaaccacctatattatctaacaattatgaattaagggcaatgggatggtatcccatcccttaatttaaaatattccagcaattaaagttagggtttataaataaactctaccccttcatcatcttcttctgtccaaccgtcatcatctaagtcgtcccaatcatcttcggtaatcgggttttgcattgcttgttgatgatagtcgtcccatttgaatgcgacttcttcttttgctttttcctcttcttcaacacgcggatttgcttcgataaagtccataatatcacgggttaaagcggatacattttgccctgttgcggcagaaatcaagtagtaatcaccttcccaaccgatctcttctacaatcgcttcggctctttctctcgcctcttcttcgccaatggtgtcgattttgttaaacaccagccattgcggtttatctgctaatttttcgctatattgatagagttctgactcaataatagagatattttgtgcaggatcactctcatcaatcggcataatgtcgacaaggtgaatgagtactcggcaacgctctaagtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaccttccgccgcaccttcaatcaatcctggaatatctgccaccacaaagctacgatccgcaccaactcgtgctactcctaaacttggcacaagggttgtgaatgggtaatctgcgactttcggttttgctgctgatactgcacgaataaaggtggattttcctgcgttcggtaaacctaacattcccacatctgcaagtaacatcaattctaactgtaaatcacgtttttcccctggtgtgccgttggttttctgacgtggcgcacgattgaccgatgacttaaagcgagtattccccaaaccgtgatagccaccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttaaagcgagtattccccaaaccgtgatagccaccttttgccaccaacattttcataccgtgtttggttaaatcgccaatcacttcttgggtatcattgtcaatcgcacgggtgccaacggggacacgcaaggtgatgtcgctaccacgatgtcctgtacaacccgcactgcgaccattctcgccacggcctgcggcaaagcgtttttcaaaacggtagtcgataagcgtgtttaggttctcatcagcaattaaatagacatcaccgccatcaccaccatcaccgccatcaggaccaccttttggaataaatttctcacggcggaagctgacacagccgttaccaccatcgcctgcttccactcggatcagggcttcgtcaataaatttcatatcttctcctatttcccatacaaactagggaaatgcttattttcttttaactaatttatgtccgaccgccgataaaatcgtgccagacaccacaataaatgcgccgatataactcaataaattcatatcagggcttgcaaaggtatcgggaaatgcccaatgtccaatgcttgaaaaaaccatcgtaaaaatcgggactaaaatcgtgactacacttacttttgatgcgtcccagtgatttaatgcttcggcatatgccccatagccaatcaaggtatttaaacaacagaaaatgaaacaacccaataaaaacggatcaaattcatctatgtttatctggctggcaaatggtgtgagtagcaatgcacagcccgtataaataatcagcaaaatctgctgtgagctaaattttgccaacattattttttgtgcaatcgcataaaccacccaaacaattgctgctcctgcaccgacaagcaacccaaaagcataagtgcctaactggaaaatttcctcaaaacgctcattaaaaaaggcgattaaaccaataatgagcaatagcaagccgatttgctgatgtcgcccaaattgttctttaaaaatcaccacaccacataaaatcatcgtaaacggcgccaattgccacaatacttggctagttgtcggtgaaataaagtttaaactatagctaaacaagaaaaagttcagcgataggcctaccacgcctaacccgattaaccaaagaaaacgtggagtgaaagcggtcagttttggcaatttttttgtaaagcctaaaatgagtaacaaaccgattgctgccacaataaaacgagcccatacgagcgtttgagcattcacaacactcaacactttttgtgctgcaatcggcacagaaccccacatcattgcagtaagcaaggctaatgaaaatccaagtaatggacgttgtagtttcatattaaatccgtttatgtcgataaaaaagtttatgcccagccgctgaaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgctccacataccacgacaactgcccctaaatgcgttaagtgattaaaatcaggttcagcaaaatgttcagggcttaaataaaatgccaactgcgaaaataaaattgtacagatcgggataagtggcatcattacgctcactttagtcacctcccaacgatttaatgcttcggcataactaccataagcgatcaccgtatttaaacagcaaaagatcaggcacgctagtgcaaagccactgagattattgacttgtgaaagatccgctaaaggcgtgaaaacaaggctacaaccacaataaataaacagtaaaatttgctgtgaactaaaccgatctagcatcatcttttgagcaatgctgtaacagatccaaatcagactagcactgactgcacagatcattccccaagcatattcattcatctgtgcaagatcgtcaaaacgatcgttgaaaaataaccccaaaccaatcagcacgataacaaagccgattttctgatgtaaaccgaagctctctttaaacaaatagacaccgataaacgccataatcaaagatgaaaaagggctaattacttgacttgccgcaggtggaatatgatttaacgctaaattaaacaaataaaaattgcaggataaaccgaataccccaagcaatagcagataataatggcggcgagtgaaagcggtcactttcggcaatttttttgcaaagaacaaaatcaaaaacaaccctatcattgcagtaataaaccgaaaccagacgatcgtttgagcgtccataaatttcaaaatttgctgcaaggctatcggcaacataccccacatcattacggcagttagagcaaagagaaaaccgagtaaaggttgtgattttgacataaatttttttgtttcaatggtaataaaaaaccccgctaattgattagcggggcattttaatcttattcttttgaagattattcagcaataatgcttacatatttgcgatttttctcgcctttcacttcaaattttactttaccgtcagcagttgcgaataaagtgtggtctttacccatacctacattgctacctgcgtggaattttgtaccacgctgacgaacgatgatgctacctgctaatacagattcgccaccgaaacgtttaacaccaaggcgtttagcttcagagtcacgaccgttacgagttgaaccaccagcttttttagttgccatctacttgatctcctctgaaattatgcttgaatcccagtgattttcacttctgtgaaccactgacgatgaccttgttgtttacggctgtgtttacgacgacggaatttaacgatgcgaactttttcgccacgaccgtgtgcaaccacttctgccactactttaccgccagcaacaactggggtaccgattttaacatcttcaccattaacgaccattaacactgagtcgaactcaactttttcacctgtcgctacttcaagtttttctaaacgaacaacttgaccttcgctcactcggtgttgtttgccgccactttggaaaactgcgtacatatttactccgctaatatgtgcctatcgctatgcgtttggcactctcaaattcatataaaataggtggacaattctacgcaaaaactcaaatgagagcaagcaagaaattgagaaaaatttgaaattcttcaaaaacaaacaaaaaagatcgtttagagaaggatctttaaacgatctttttaagctcactcaacacattagagctgagcccacttccaatttccattcaccgctgtacctaatacctcaaactgatgattaaacgcagttaaattggcaattttgccagcttcaatggatcctaacttatcttcaacatgaatagcacgagctggatataatgtacacatacggatcacttcatctaacggaagatcagtatgttgcatcatattacggatcgactcgatcattgtaatcgccgcaccgccaagactgccacactcatcgacacatttaccgtctttgtaccaaactttcttacctacaaagataaaatattccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagataaaatattccatatcagttgtaccagctggggcaaccgcatcggttacaatcaccaatttatcgcctttcactttcttcgcaatacgcacattactccaatcaacgtgcaaaccatcgacaatgataccagcgtaaatatcgctatccaacactgcaccaactactccaccatcgcgcccagagctgatcggcgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcaaagccaatgccttgctcaatacgtcgttttgcttcggcaaaggtcgcatttgagtgtccgatagacacaataatcccagcttcaacaaatttctgaatatgatctgccgtcgggttgtctgctgcgagtgttaatttcgtaatgacatcaccgtttttgcaaagaaaatccaacatctcaccgcttatttcacggatatattcagggcgatgaaccccttttttcgccacacttaaataaggtccttctaaatgcaaaccgagtgcttggtttttatatttagccaaatagtcacgcattacttgcaccgcttgtttcattccttcgtcaggcgaagtaataaaggttggcaaataacttgttgtacctgatttcaggttagtttcttgcataatttcaagggttttaacactaatatcttcattaaatgttacaccgccacaaccgtttaactgcagatcaataaaaccagcagaaagatttgcgccctctaaatcaatctgatgaaccccatctgcaacttgactttgatgaaccacagcctcaatctgctcaccattgacgatcaccgtatgctgatatagcacatcacttcccgtataaatcacacaatttgttagtgcataacgccccatcttttcctcctagcgagctatattttgctctaattgcttgaaatacttaacggttttaactttcaattcttgtgttgcaggttcatcacaaaccacgactgcacgacgatgtaattgtaacgcactgatcgtccacaaatgatttaccgccccctcaacacaggcttgcaaggcaagggctttattataacccgtgactaaaattaatacttcctctgcgtccatcaaagtaccaacccccactgttaaagcaaattttggtactttattgacatcattatcaaagaaacgagagttcgcaatcaacgtatcttcggtcaaagtcttgatgcgagtgcgagaacttaacgatgaagcaggttcattaaaggcaatatgcccatcaacacccaccccccccataaagagatgaattttgccataagagcgaatttttgcttcataacgttcacattcagcatctacatcttccgccattccatttaggatattcacattttctactggaatatcaatatggttaaagaagttatggaacataaaatagtggtaactctctttgtgctctggcggtaagccaacgtactcgtccatattaaaggtgacaacgtgtttgaaactcacttcacctgcttgatacagcttaattaattctttataggtttgaagtggcgttccccctgttggcaaaccaagcacaaaaggtttctctgctgttggttggaaagcattgatcttatcagcaatataacgagcagcccaacggctcacttgttcagcacaatccaaaggcactaaacgcataaatcctcctagaaaaagtcaaatttgaaataaaacttcattgatgatcattataaagaaagatttgcttcatttgtagaaaatttacttaaaatttgaacaagatcataatttatcatgaaaaagcccttgctcagatacaatcaatatttttaagttcctacaaagtattccagtaatactccaataggacgaatagaatattgtgggttattcatccaaaagtaattatctttattctgaaatagtaaactaaaaccaagctagataatctcaagaagattgggactatagttcataaaagcataacgatagtgtagtttatgcctgtagtaccagaatatatatttggatcttaaactactccgtttattccaatatatctcatattctataacttatgacttcacagccccatcataaatatgttctgcgtcacctgtcatataaagcggtgaacctacaccttgccattcgatatgcaaggttccacccggaagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttgaacacggctatccaataagccttgcataatcccaaccgcaacagccccacaagcaccgctaccacaggcttgcgtttcgcctgcaccacgctcaaacactcttagtttgatatgatttcgattgatgacttgcataaaaccgatattggcacgctctgggaaacgttcgtggcgttcaagtaaagcccccaattcattgacattggcggtttgaatattttccacctgtaacacacagtgcggattgcccattgaaaccacaccacataacaccgtttgaatatccgtgcgtaaaatataatttttttcaaacttatttgcggtaaaaggaatttgtgcaggttcccaaattggttcccccatatttacgcgaacttgaccatcgtcttgtaagcttaaaaccatcttcccttttgcggtactcacaccaatgtcctgcttgttggttaagccttttaaggtaacaaaacgagcgaaacatcttgctccatttccacactgagagacttcactgccatcagcattaaaaatacggtagtggaaatccagttccggatcatagggtggttcgaccagtagtagctgatcaaaacctacaccacgatggcgatctgcccatttacgaatgagttcttccgttaaatagacattctgcgttactccatcaatcaccataaagtcattgccaagtccgtgcatttttgaaaactgcataatttttcctagtattagaattttttattgatctagattataacgattataaatttttatgctatattgcacgccttttgtataaagggcgaacaatcgccaattcttcctcagtatgagggctttttcgttaaattacaatggagcaaattatgtctgctatgtttcttattgaatttgccgttgtattactctgtattttaatcggtgctcgtcttggcggtatcggtttaggggtaatgggcggtttaggtttggcaatcctctcttttggatttggcttaaaacctgcaggtcttccaatcgacgttatgtttatgattatggctgtcgtttctgcagcggctgcaatgactatatgatcaaaatcgcaacaaacattttacgtcgtaatccaaaacacatcactttcatcgcaccagcggtaacttggacatttactttcttagctggtacaggtcacgttgcttactctgtattgccggtgattgcagaagttagtcgccataacggtatccgtcctgaacgtccactttcaatggctgttattgcctcacaatttgctattgtagcaagcccgatttctgccgcggtagtgcttgtgcattttattagtaactattccaggcacgattttaggtcttttctgtgcgtgtttattcgtaaataaaatgggtaaagagttaaaagacgaccctaattatcaacgtttattacaagatcctgagtatgtggcaagaaatcacgtagatacaaacccagcagagatccaaattagcccaacggctaaaacctccgtaagtttattcttatttggtgcattacttgttgtgtattcgacggcaaagcaatgggaatggctcatactatcgaaatcgtgatgcttactgttgcagcattaattatgcttatctgcaaaccaaatggtaacgcgattacacaaggttctgtattccacgcaggtatgcgtgcggttatcgcaatcttcggtattgcttggatgggtgatactttaatggacgctcatatgaccgaagttaaagatatggtgaaaggcttagtggaaactgcaccatgggcatttgcgttcgcattgttcgtactttctgtattagtaaacagccaaggtgcaacagtagcaactctattccctttaggtgtagcgttaggtatcccagcaccaatcttaatcggggtattcgttgcagtaaacggttacttctttgttcctaactacggtccaatcattgcatctattgactttgataccacaggaactactcgcattggtaaatacattttcaaccacagctttatgatcccaggcttattaagcatggcatttagcttagtgtttggcttagtattagcgaatgttttactctagtagaacttcaatttgatctacaccaaaagctagactttttaatagaagggctgagtgctatatttaatagcgctgagtccttttacccttatttgaagatacatatcagacatttctggtttaatctcaatacctttatctgtctaagcgttacttataaaaatggctcatagaataaaaatagcttaaagtcttttattataagactttaagctatatgaaaaggcatttctcgttaaaaagtattattagctaataatttctagtccttttttaatgttacacaccgatttcccactaaaaaagcaataagtccaattactaatgctggcacgatggcgtgaaagctaaatattttgatagataggcttgtcattaacacataacttgataaacctgcaatcattgaacaaatagcccctgttgcattcgcttttttccagaatagtcccaatacaattacccataagaatgtcgcttctaaccctcccagagagagtaagtttaaccaaatgagcatttcaggtgggttaatggctgcgatcaccaataaaacgctgatcactagggtagtgattgtcgagaaacgtttaattttttcttcattttcaaccgcttgtggcttaattgcgagatagagatctttaatcagggttgaagaagattgaataagcattgagtcgattgaggacataatggctgccattggtgcagctaagaaaatgcctgcaacaacaggcggaagtacttgtaacatcaaggttgggataacttgatcggcaacttttagatcgggaatcaccgctcgtcccaacgcacctgctaaatgcataccaaacatcaacacagcaacaacgacagtgccaataatcaaagctcgatgtaaagccttgctatctttatatgccatactccgcactgcaaaatgtggcaatccaattagaccaaagcagaccaatacccagaaagatgtcataaaggtgaagtctagtggacgttcatcaataccataaggtgcagtcagttgagggttgatattttctaactgggtaattgcagcatcaacgcctcccgttgcataaattacaccgccaagcagtagtaatgtgcctacaaccatcactaagccttgaatcgtatcggtcaaaacgacggcacgaaagcccccgataaaggtataaataccaacagtgaccgcaaaaataatgatcgcggtgccgtaggaaatgccaagcgtagtttcaagcaaacgtccagcaccgataaactgtacggtcatcattgcaaagaaagagagcaatagagcaaagctagcaatccacaccacaaagcgatgttgataacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttggcgagcaaacatcgcaatgcgtttgccaacaatccctaatgagagcaaaacggctggcacttgaatcattgccaataagacccagcccaagccatatttgtatgccgcacctggcccgccaataaagctacttgccccaacataagtggctgctgtcgtcattgccaaaacaaaaccagacattgagcgtccaccgacgtaatattctgataaaaagctaccgcttgtacgttggcgataggcataataggctacgccaaatacgaaaatgagataggcgattaaaggtaacaacaactcaagattcatcttttccccctaaatcaatatcttgataaatccattttactactgcgctgatcaataacgttaatacgattggaagatagacacaacttaattcaaaccagaggggaaagcctaaaaaacctcgccctgcaggtgaaaaataagcaaaaccgacccaacccataacataaaatagcgtcagatataatgcccaacgcacttcacgatctatttgtttagacaccttcatagtcctcctattttttagctaaaataaaacctcgcagttgagaggtttgaaatcatttaatattgccacttatctggatctattcctagctctcgcattttcagttttgcttcctcaggaatttcattgctacgttctttcattaaatcatcgtcggttggcaatggctgacctgtaaaggcgtgtaaaaacgcttcacaaagcaattcactgtttgtggcgtggcgtaaattacgaatttgacggcgagtgcgttcgttagtcaaaatttccaatactttaatcggaatagataccgtaattttctttacttgttcactttttttaccgtgttcagcataagggctgatatattcaccgttccaatctgccattgtctgttcctaaatataaaagttggcgtgcattttaatcaaaactttatgttatcgcaatcttgaataatagcgcctgttcagatgtaaggcattgttctccatctaaaaataatgtcattttccttgacggctcaattctaaatctgtaccattcgcccgtttttttcactttgaggatacacattttggacagtcacagtcgatacttatcagttttttaacccacctcgtccaaaacctctttgccgatgagcgtcggtaattcttatcagtatcttatattttgttcctttttgttcatcgcctcatatccaatttttaggagtatgaaatgatcagagctttttcgttaaataacgatcgcctagtcagtgtagatgaaaatattcaaaatcaatttaatgaagctatttggatcgatttgattgatcctacagatgaagaacgtggtgttttagaaacgcgattagatcagacccttgcggaagaacacgaattggaagacttagaggcttctgcacgtttttttgaagatgaagatggcttacatttacactcattcttctactgcttagatgatgacgactatgccgatattgctactgttggttttactattcgggacgggcgtttatttacattgcgtgaacgggatctaccagctttccgtttgtatcgaatgcgctcccgtcgtgcaaaattgatagatggcaatgcttacgagcttctacttgacctatttgaaactaagattgagcagttggcagatgttattgagaatatctatgcagatttagaaaaattaagccgtgtggttctcagtactcacgagggagaaaataagagagagcataattttgatgatgcccttgctgaattaacggaacttgaagacgccagctccaaagttcgtttatgcttgatggatacacagcgagcattgagtttcttattgcgtaaaacccgtttgccaaataatcagcttgaacaggctcgtgatattatgcgagatattgaatcacttcaaccgcataacgaatctctcttccaaaaggtaaactttttaatgcaagcggcaatgggttttatcaatattgagcagaaccgtattatgaaatttttctcggtagtgtcagtgatgttccttcctgctacattggttgcttctacctacggaatgaactttgaatttatgccagaattaaaatttcaatatggttatccgatggctatcggtttgatgatttgtgcggctgcgacaccatatctttattttaaacgcaaagggtggctatagatatttaattttgtcctttaagcctaaaaaagtgatgtttgctacattaattagttcaacttcaatgattgtcaccagataatagccacgcataacgtggctattttgcttttaacgtattttctcaatcaactccgccacaaacgccaagcgatcttccgcccgttccattggcttggtaaagcggaacttcaacggtccgtcaaatttatagacatttttatccgcttggatcagttttaagaacttcatcggatcaggcgttgctgttggtttgaactcaagataaccgccgttgatccctgcatcgacttttttcaactgtaacccttttgctaaatggcgtaactgagtaatttggaacagatttttcgtggcttccggcagtaatccgaagcggtcaatcagctcaattttcagatcttttaaggcttcatcactctctgcactagcaatccgtttatagaacgacaaacgcatattcacatcaggcagataatcatcaggcagtaacgcaggcacgcgtaattcaatatccacttgttgttgggtaatttcgtctaaagtcggctcacgcccttcttgcaaggctttgaccgcattttcaaacagttccatgtagagtgagaaacctaagctctcaatctgtccgctctgttcgctccccagcagttcacccgctccacgaatttcaagatcgtgggtcgccagcacaaagcctgctccaaggttatcgatagtactcatcgcttctaatcgttgttgagcatctttggttagcgtttttggcggtggggttagcatataggcataggcttggtggtgcgaacgtccgacacgcccacgcagttggtgtagctgtgccaagccaaatttatccgctcgctcaataataatggtattggcggtcggcacgtcaatccctgtttcaataatggttgagcaaaccaacagattaaagcgttgatggtagaaatcggacattacccgttccaactcacgctctcgcatctgcccgtgtccgatcacaatacgagcttctggtacgagttcggcaagctgttgagcggtattttcaatggtcgctacatcgttatgcagataataaacttgtccgccccgcagaatttcacgcaaaatcgcttctttgattaccgtatcatcgctttgtcgcacaaaggttttgatcgacaaacggcgagccggcggactggcgataatcgatagatctcgcattccgttcaacgccatattgagcgttcttggaattggcgttgctgtgagggtgagaatatcaatgttggctcgtagttgcttaattcgctctttttgacgcacgccgaaacggtgttcttcgtcaatcaccagtaagccaagatccttgaactgcacatcttcttgcaataatttatgtgtgccgaccaaaatatcgaccttgccgtccgccacttttgccaaaatctctttctgcgctttggcggttttgaaacgggaaagcacttcgacattgatcggataattagcaaaacgatctttaaaattctcaaaatgttgctgtgccaacaaggtagtcggagcaaggatcgccacttgtttatggttcattaccgccaagaaggtcgctcgcattgccacttcggttttaccaaagccgacatcgccacacacaaggcgatccattgctttcggcaagcacatatcgctaatcaccgcattgatcgccgttttctgatcttcggtttcttcaaacgggaaagtgttgctaaattgcacgaacgcatcacgatcgtactcgaacgcaaagcctttttgtgcttcacgtttcgcatagacatcaagcaactccgccgccacatcacgaattttctccgccgctttttgacgagttttcgcccacgcttccgatcccagtttatgtaacggggcattttcgtccgttccgccgatataacggctaattaaatggagcgaagccaccggcacataaagtttggcatcgttggcataatgcaacacaaggtattccgccttaataccgccagcatcaagggtggttaaaccgccataacgcccgactccattttccaaatgcaccaccgcttgcccgattttcagctcggcaaggttgcgaattaaggtgtcaggattaacggttttacggcttttctcttgtcggcgactttgctgtactttctcgcctaacagatccgtttcgcaaattatcgccagtttttgaccgcttgtttcaataataaacccttgatcaagcggtgagattaacaaagaaatttgcgaattaatctcagccagttgcttcacttgctttggcttgatatttagcggtgcaagtagctcaagcaaggtttcccgtctgccttccgtttccaccgaaaagagaatttgccccttgaatgtttgttgaaactgtaaaaaagaggcaaaaggttctttttggttggattgcaccgcaatgtcaggcaacggctcaaggttggcgttctgcttagccgccgaactgcgaactttctcgttggttaaagttaaacgtggatagccttttagctgttggttaatctgatcgatattaaaccaaagctgttcaggtggaagtagcggtcgcatcggatcgacacggcgactatcataacgtcttgcggtatcctgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggctttttgctgaatatcggcaaaggtaataaacaacgtctgttcaggcagatactcaaacaagctcgccatttgctcaaaaaagagcggttgccagtattcaatccctgcattcaaaatgcctttgctcacctgctgataaatatgctcaggttcacggcgaatttcaccgaattgttcacggaacttgccacgaaaatactcgatcccgttgctatctgtcgggaactcgtgggctggcaataaattgattgcatcaatctgctcaatggtacgttgattatccacatcaaaggtgcggatcgtgtcgatttcatcatcaaaaaagtccaaacgataaggcgaattagcccccatcggatagagatcgagcaatgccccacgcaccgcatattcaccatattccagcacttgttccaccgctcgatagccggcattttccagttgtaagcgtaatttctcaatcgaaaaacggtcgccttttttaatcaacaatacattgttcgccaaataactcggtgggcagactttttgtaataaggtattgattggcaacaggaaaatctgcttctgcccttgttgcaactgaaataatgcagataaacgggcggaaataatatcttgatggggcgagaaattgtcgtaaggcaaggtttcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattgtcgtaaggcaaggtttcccagtcaggaaaaagctgaacaggcagtttcgtgaagctcggcaagcttttttccaaccgcaacgctgtgcgagtatcaggtgtcaccaccaccgtcaagccttgaaattgctggcttgtctgcacaatcgcaagggtatcggaatgcccgattaagttacctaaagtttgatgatcttgatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaaagtttgatgatcttgatgtgtgctgtccgctttcggcagacgaaattgaagttcaaatgacatacaagcggtttgatttatccgaaatattgcaaatgtaagaattgtactcgctatgggggcgagttgcaaaagattgaagggaataggagcgcttgtattatgtgagtgaatcttaaaatgcttaccaataatgatgatctctgtatcatagagaataattaaagcacgatatgaataatagttctttatataaaaaatcaacattgtaaaatatattcataacataggattagctacatattcagatagccgtttatagatattcaaatgttcttagaaaaactactactcactcgtcgttttatttcgacccttgcttatttttcaatgcaaacggtcttttttatctacctgcaacaaaaaggcttatctaacgctcagatcgcattttcgttgtcggtactgtttttttgtagccaagcccttgcaatttttgcaggggtgctaggcgaccgctatggtttggctaaaatgatgttagtcggctgtatgctcgatgtgatcgcctatgttttcttcttgtctgcggaaagctacacggtgctattaatggcgacaatgtgctttggtatgggaagttgtctgtttgcaactaatgcaagggcgtgcttacttgcattggctggcgatgaatatgcggcgaaaacccgtttacaaggcaaattcttacgggtcaccagtatgtcgtcgatggcagctccattgcttgcaattccctttatcaagtatgagcagatcaatgcgttaatctggtgctgttttttattggaagcggtgttatttgtgtttatggcaaagccgttctaccaaatggaaaatgtgaacaatttagtgaaatttcgttgggggcaaattcgggaaatcatcaccaaagagtttatttttgttcacttaatgctgtttgtaccgttaagtgtcgcaatgtcgttttttgtgatttttccttatctgtttgacaataaactcaatgccccagagcagatcccgattgcgttatttatcaatgggttgatgaccgttgccctacaatcgtatttctccaagcatatcaatttaacccgtaagcaacttattttcgttagcccgattttagccgtcggtatggttgtgccttggtttatcaccttgcattatgcttcgttggtttctggctatctctatctggtgatttttaccttgcttgaagtgtatgcattaacggcaatggcgaatttattagtgaaatttgataacggtaaaaatcgtggatttatcttcggatcgtcccgcttgatccagtcgattttgacgatgatggtgatgaatttaattcctgtgttgtttttggtataaaaataagcggtaagataatgtattttgccttcatcttaccgcttatagggaatgctattttaaaagatactctcttaacttcgcaaaatctgccgccattgtgtccgacaacagttccattttgttatgtttatctaacgcttcaggtaaaggcagttcaatgtctaaaatacgctctacgctctctttaaatttcgcagggtgtgcggtgcaaaggaaaatacctgtttcgccagcttgtagctgatctttcaatacttggtaagcgattgccccgtgcggttcacataagtaaccttccgcatattgtgcttttaatgcttcttcggtttctgcatcatttaaggcatctgaacctaaattcgccaaattccaaccattacgtttaaacagctcttcaacgcgaggccagttgttcggacgacttacgtccattgcatttgataatgtcgcaaccgttgcattcggttcccatttgcccgatttaagataacgtggcacagtgtcgttcgcattggttgaagcgataaaacgcttaatcggtaagcctaaggttttggcaattaagcctgcagttaagttaccaaagttaccgcttggtacagaaaccaccacatcgctacgtttctctttcggcaattgagccaccgcttcaaagtagtaacaaacttgagcgagtaaacgactgatattgatagagtttgctgagtttaagccgatagcttgacgaagttccgcatcatcaaaggcttgtttaactaacgcttggcaagcgtcaaagtcagattcaatcgccacggtacgaatgttaccgcctaaggtacagaataatttttcttgtaatggactgattttacctttcggataaagaataaccacattgatattttctaaaccgtagaaagcgtgagccaccgccgcacctgtgtcgcctgatgtcgctgttaaaatggtaattttgccatcaccacgcaccgcacttaatgcttgtgccataaagcgaccgccaaagtctttaaaagcgagggttggtccgtggaataactctaacgcataaatatcatcattcactttcgctaacggagcagggaaggtaaaggcattttttaccattgcatttaaggtttcttgtggtaattcatcgccaatcaatgccgataaaatcttttggctacgctcaaccagcggtaatgctaataaagcgtcaatgtcgtcaaatttaggtaacacttcagggaaaaataagccctgatctttgcctaacccttggcgaacgccttgggcaaaattcacttgttcttcagggtgtttgatgttgtataggttcattaatgttgtcctttattatgagtaatcagaaatggaatgattgtatccgttcacttctgttagtcaatcacaagcggtcggatttaggcgattttttgcaaaaggtgagattaaaattcaatttatgtaaacgattgtgttttttaacctgttgtttttatatacaaattcaccaaacaaatgagatttacatcacaaaatttacaaaatacatttgcaatgtaaagtctttcagataaataatcacatccgaacataaaatgtttgaaatcgaatttttcaaaatcataaaagttacaaaggagcttgtatgttttcttttctaaaggcatctgcacctgcaccgagaattgaaagttctcgtacagacgcagaatatcgcaaattacgttggcaagtatttgctggtgtatttattggctatgcagcttactatttgattcgtaagaacttttctttagccattccttatttaatcgacgaatatggatttagcaaagcagatcttggtacggtcgcagtggcattatcccttgcttatggatttagtaaattcattatgggaaatgtttcagatcgctcaaacccaaaatatttcatcactattggtttattaggttctgccatcatcagcttgatttttggtttagtacctggtgtactttcttcaattccattaatgatcttacttgcagctttaaatggctggttccaaggaatgggctatccaccaggtgcaaaaacaatgaccaactggttctctcgttctgaacgtggagcttggtggagttggtggaacgtgtcacacaacttaggtggcagtttgattggtccattggcgattttaggtttatctatcttcggtgtatggcaatccttgttctaccttccagcattgattgcgattgtacttgcctttgtggtgctttacttaatgcgtgatacacctgaatcacaaggtttaccgcctgttgatgagtggaaaggcgagaaagtattagaaaaagtggaatcagcacataccctttcttcaaaagatattttctacaaatatatcattaacaataaattcttatgggcaattgcgattgcgaacgtgtttgtttacttcattcgctacgggattattgactgggcgccaacctacctaaaagaagttaaacactttaccgtagataaacaaagttgggcatacttcctttatgaatacgcaggtatctttggtatgctcgcaagcggttacttaagtgataaagtattcaaaggtcaccgtgcaccgccaatgttattattcctcgttggtgtattaattgctattgtagtttactggaaaaacccagctggcaacccattagttgataacatctgcttagtggcgattggtttcttaatctacggtccagtaatgatgatcggtttacaagcggcagatttagtgccacgcgttgcaacaggtacagcaacaggtttaactggtttattcggttacttacttggttctgcaagcgcaggttgggtaatgggtaaattagtggatgtttatggttgggacggtggtttcttttgccaaaatccgaccgcttgtacttgtaatttgccaatctggctctatattacagcagtcattattttaatgaatgtaggggcgaggtttatcctcgcccgaatttatataaacacattaacgggggatcccctctacacataaggaaaaattatgtctttaaatttagaacaagtgaaattagaaagcgttgaagcaaaaggcggttatggtatcggtttacaaattgctcagcaattattaggcagtggtttagatgttgaaccggaagcagtggtaaaagggatttttgatgtgttaaatcaaaacccacctgcattagatttgaatgaagtaaccaaagcgttacaagagttatctcaacgtgccgaagcagaacaagcaaaagcttttgaagcgttagcggcagaaggtaaagcgttcttagaagagaataaaaaacacccagctgtgaaagaaacagaaagtggtttgcagtatgaagtgttagtggaaggtacaggtaaagtgcctgcgaaaacagataaagtacgtgttcactatacgggttcattaatcgacggtacggtattcgacagctcagtgaaacgtggtacaccagcagagttcccagtcaccggcgtgattgcaggttgggttgaagcattacagatgatgcctgtgggttcaaaatggcgtttaaccattccacataaccttgcttacggtgagcgtggcacaggtgcgtcaattccgccatttagcacgttaatttttgaagtggaattattagatattgtttaagtgataaaggacgtcatgctggcgtcctttatcattcaatgaatcgtcttatttcaacactgccaacgccgctgcatagtcaggctcttgtttgatttcagggactaattcactgtgtagcactttattgttttcatctaatacaatcactgcacgagcagttaaacctgctaatgggcctgttgcaatatctacgcctaccgcttgatggaaggctttgttgcggaatgttgaaagtgtttgggcatttgcaattccctcagcaccacagaaacgtgcttgggcgaaaggaagatcagcagaaatgcaaagtaccactgtgtttgcgagttcggcggcttctttattgaaaacacgcacggaagttgcacaaatacctgtatcaatacttgggaagatgttaagaactttgcgtttttctgcgaagtcggaaagtgatacgttttctaagccattgctcactaatgtaaaatctgccacgaaactgtccgcttgtggaaattgtcctgcaacttcaattgggttacctgctaatgtaatttgggtcataactgctccttaatggttgaaaaaacctgttcaatataacgatttcttgtgtaaattgaaatgaattttaacgatagtttttggttatctttttggcaaatagcaatatctcggctatacttccgttggtattttttttcaaaggtttttgactatgttaaaactatttcgcattgttgcagttgcttcccttgcaatgttaatcagtgttattggtactctttatgcgttaattcgtttacgccaccctgatagtgttagcgttgtggctaaaatgtttggttctcttcatcaattgcttggcgttaaattaattacacgaaatagagctgcgtttgatcaacctgctatctatatcggtaatcatcaaaataattatgatatggtgacgattgcggcgatggtgcctcctcgtacggtaagcattggtaagcgtagccttatttggatacctttttttggtttgatttattgggcgacggggaatatttttattcatcgtgaaaaacgtagtagtgccatcaatacgatgaataaagtaggtgaaattattcgtgataaacagctctcagtatggatgttccctgaaggttcgcgtagtcgtggacgtgggttgcttccttttaaaacgggagcatttcatacggcgattgcagctggtgtgcctattgtgccgattgtctgttcaacgactcataataaaattgacttaaatcgtaaggataatggcgtggtgatttgtgagcaattagaaccgattgatacgtcgggttatgaccgtgaaaatctcaaagagctgattgaaaaatgtcaccaaattatgcaggctaaaatagaacaattagatcaagaagtcgcacaattagaacgtaaataatatgaaactttctcgccgtcaatttttacaacgctctacattagctggggtagctacttttgcccctacgtcgttatgggcgaaaaatcgtcctagtttaaccattccgccgatgattgaagtggggcgtggtcgtcctgttcgattggattttcgtcctgctcaaacgcaatttaataaagggaaactggttgatgtttggggtgtaaatgggcgttatcttgcccccactgtacgagtgaagtcaggtgattttgtcaagctgacctatactaacaacctgccacaagcattatcgatcaatatccaagggctacaagctccaacggaaatggtcggttctattcaccgtgctatagacaaaaacagcagttggtcgccgattttatcggttaatcaatccgcttgtacggcttggtatcacgcagacacaatgttaaattccgctttccaagtttatcgtggtttggcaggtttgtggatcattgaagataatgaaagtagaaaagcgtcactgcctaataaatatggggttaatgatattccgctgattttgcaagatcagttgattaacagtgatggcgttcaagtaattgacactcaaactaatcaattttttggcaaacgcctttttgttaatgggcaagaaagcccttattttgatgtacctcgtggctgggttcgtttgcggattgcgaatgcttccctctctcgtcattatgatttacgtttagacaatggcaaaccgctctatttaattgcaacggggattggttttttagcggatatggttgaaatggaacatatttcccttgctccatcggaacgaattgaagttttagtggacttaaatgagggagataaggtttcattaatcactggcaagaagcgagatttttttgatgaaattgggaaattattcaaagataacaatgggttaaatgataatgtggtgttagagtttcgcccagaggggttgccttcagcgttaaatgtgacaccaaaacttcccccatttaatgtggaagagtttaacttaaaaattacccaagaacgtaaaatcaatctccgcccacaagaccgtttaatcaatcagcaacgatttgatcctaagcggatcgattttacggtaaaaaaaggaacagtggaacgttggtatttgaccacaacggaagcggttggttttaccttacagggtgccaaatttatggtggaaacgagaaatcgtcaggctgtgcctcataaacagttggcttggcgagattgtgtatggttagaaccaacccaagaaactacattgttagttaagtttgagcatacagcctctgagcaacagccattcaccttcggggtatccgatttaatgttacgagatcgtggctgtatggggcaatttgttgttgcggaatagcattaagcggtcggatcagcgagaaaacttgcaaaaaaatgtggaaatcttaccgcttatgtcacattcactgataaaatacagcggtttttatttctgccaaaacagataggaaaaattatgacaacagaatacttagattttgaattaccgattgcagagcttgaagcaaaaattgaagcgttgcgttccgcagtaggtaatgacaacaaaatcaatcttgatgatgaaattgcacgtttacagaaaaaaagtgaagaactcaccaagaaaacgttctcagatttagatgcgtggcaaatttctcgtatggctcgccacccaagtcgcccttataccttagattatattgagcgtatttttaccgaatttgatgaacttgctggcgaccgtgcttttgcagatgataaagcgattgttggcggtattgctcgcttagatggtcgtccagtgatggtaattgggcatcaaaaagggcgtaccgtgaaagaaaaagtgaaacgcaatttcggtatgccagcaccagaaggctaccgtaaagcccttcgtttaatgcagatggcagaacgtttcaatatgccgatcatcaccttcattgatacgccaggggcatatccaggcattggtgcggaagagcgtgggcagtcagaagcgattgcacgcaacttgcgtgaaatgtccaccttaaaagtacctgttatctgtacggttatcggcgaaggcggttcaggcggtgccttagcgatcggcgtgggcgataaagtgaatatgttgcaatacagcacttattcagtgatttcccctgaaggttgtgcctctatcttatggaagagtgctgaaaaagcctcaaccgctgcggaagtgatgggtttaaccgcaccacgtttaaaagaacttgagttaattgataatatcgtaccagagccattaggcggagctcatcgtaactttgatgagatggcagcaaatttgaaacaacgtttacttgaggatttagcagacttggatccgttaaatgcagaagcattgcttgatcgccgttatcagaggttgatgggttatgggtatgtgtagagaattttaggaggaagtgaaaaattttgtgatcttgctccaatttttgaaaaaaaagttgaattatttcttcgcctttatttcgtatttagagtattataatcgttgtcaaataataagaaaaaattcctcaatatcgtcgagtttatgtggcattatttaatccgtaatgccacattttttattttgtctactatgccttttattttcactgatgccgcttaaaatggggtttgaatattcttaaactcatttgtcttatgttttgtgtagtggctaggctttctgggatgcttatataatcacctcatacttctgtataatattaagaatagctatctgattgaggaagaacagtttaatattttttagtggagactattagctcagtacgcttataacttttaaaaaatattaaaaatgttattttcatcttccttcgttttttaaaatgtctatgtgcgtaaggagggatattgaaaggggaatgtaagaaaatttatcaaaccttgaatggtccccctaccgcacctgatctaatgatataactatttgatagttaaaggttattttgttttttatttttctctgtgttcctaactgtgttcctaaagttaaaaatcatttttgtatggcagtagcagtattttaacctatccacaaaaagcgaaacattctacgaaaaaaaataattttttttgagcctttttagtcacttagtcactgaaaacgctctaagccttgtgtgacaagggtttgctgttagtgacagaaaaagtgaagtgatttttaaaccactaaaatgtagtgactaaaccactaaatgccttaaatttcaaaaaaattaggtgaaaaaaaggcgattttactcgcctttgatgttgataatgttgttgcttaaccattttcccaacgttgaatcgtggtaaggcggtctttccagtggatatttagtaaggtgtagccgttttttacacctatttctatcagtttttctgtctgcccgctatctcgtaatgcatcaggaaaagcctgtttgaatgattgaaggtttaacggctgctgtagtcttaagcattcacaatagaacaagtaggctttgaagagtgctacatcttcagatttttgagtgcgattacttccccacatcattaaaggctttagattgctgtcaatcttgaaagcactggcaaaatctactagatggttcgcttctcgttttactgcaaccgcttcaccttgagcttgataatcttcaagaatcaaacgggcttcttcagggttgggaaaacgtgctagtaatttattgactatgccatagacttccgctcgcaccttttccataaagtaaacatctttcttctcctttggaattttacgatcaaacaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaacgataagcaaaaaggataaaaaggctttggggctttgtgtatcaagggttttgcgaaaggttgcgataggctaagaaaggttatttggtcccccctaccggacttgaaccagtgaccaagcgattatgagtcgcctgctctgaccgactgagctaaggggggaatctcaaaattacggtgaattatagaaattatttgggcaaaaatctagttatcttgttttatcagatgaaaaaaaggtcaattctatctaaataactagtatctacttgaccttatagataatataaatgggtatattaatctcttccccaccgttagactagttcagcccttttaattgcacttgaatatatgtgaatcgtttaataacttgccattcgatatagctaacttggttcgtcagtcgggagaatagttcaaacttgggagtcattgttaaatcataagcaataatttcatcattaaataaaaccctgaattagcgataggtgaggtttatcctctatacgttaatcgggctgcttagtctaactgttaggcgctgaacagccaccaatctcttatcaatccaaactttttgttgttttatatttcatttggttatttgcaagcggtctaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgcaagcggtctaatttgcccttaaatttgcaagcaatcaatcttacctatcaaaaggaacttattatgtttaaaaaattatcaatcgttgcattatctttagcggcagttttcacttctacagcagcattggcaaaagagtctttattagatcgtatcaacaacaaaggcactattactgtgggtacggaaggaacttatgcacctttcacttaccacgatgcaagcggtaaattaacgggctacgatgtggaagttactcgtgcagtagctgaaaaattaggcgtaaaagttgattttaaagaaactcaatgggacgcaatgttagcaggtttaaaaggtgagcgttttgatattgtggcaaaccaagtaggcttaacaaccccagaacgtcaggcaacctttgataagtctgcagaatatagctggtctggtgcgatgttattagctcgtaatgatgaaacccgtgtaagcaaagcagaagatgtgaaaggcttaaaagcagctcagaccttaagctctaactatggcgaactggcacagaaaaatggggctgaacttgttgcggttgatggtatggctcaggcgttattattaattcaacaaaaacgtgcagatgtgaccttcaatgactcgcttgcattgttagattacttgaagaaaaatccaaattcaggcttaaaaccagtttggcaatctgcggataaagtgggagctggttttattgtgaacaaaggcaacaccgaagcccttgcaaaaatcagtcaggcagttgaagaattgaaaaaagacggtacacttaagagattaggtgagcaattctttggtaaagacatcagtgttaaataatttattactctctctaccatttatgaccgaagctcgtgttgagctggtcataaatggtttctggccgatggtacaagcggcctttttagtttctatccctttggcaattgcttcctttattattggtatggcgattgccgttggggtagcgttagttcgtgttactcccgtcaatagcgcgttccatcgtctgttactctggttcgtcaaaggctatatctcgatcattcgtggtacgccaatgttggtgcaaatctgtattgtcttctacggattacctgcgattggcatttttattgatccgatcccagcggcaattattggtttttcgatcaatgtcggagcttacggttctgaaactattcgtgcagctattctttctgtgccgaaaggtcaatgggaagctggttataccatcggtatgacctatatgcagacattccgtcgtatcattgcaccacaagcgtttcgtgttgccgtaccgccattgagtaatacctttattggtctattcaaagatacttctctggcatctgttgtgacggtcacagagatgttccgtgtagctcaacaagtggcaaatatgtcctatgacttcttaccagtctacattgaagctggcttgatttactggtgtttctgttgggtgctgttctttattcaagcacgcttagaaaaacgttttgatcgatatgtggcgaaataacaatgattaaagtacgaaacattcataaaacttttggcaataacaccattttgcgtgggattgatttagacattcaaaaggggcaagtggttgtgattttagggccgtctggctcaggtaaaaccacctttcttcgctgtttaaatgcgttagaagtgccagagcaaggcacaataacctttgataacgatgccccgttgtacattgactttgcaaccaaatcagccaaaaaagagatcctagccctacgccgtaaatccggtatggtttttcaaaactacaatctctttccacataaaacagcaattgaaaatgtgatggaaggtcttgtgtttgtacagagcaaaaaacctgaacaagcaagggaagaagccttagcactgttagccaaagtaggattagcagataaagtcgatctctatccattccagctttctggcggacagcaacaacgtgtcggcattgctcgtgctttagccattcaacctgaattaatgctgtttgatgagccgacttctgctctcgaccctgaattagtgcaagatgtgctaaacacaatgaaagagctggcaaacgaaggctggacaatggttgtggttacacacgaaattaagtttgcgttagatgtggcagatgttgtggtcgtgatggacggcggtgaaattgtagaacaaggctcgcccgagcaacttttcagcaatcctaaacacgaacggacgaaacggtttttgcatcagattaataaaaattgagcatctgagtactaagtggtttgtaataacttatgttcgtaatactgacaaagtggcaaaagcagcacaagacccttatttgttgatcgtaggcagtgcaggtagttgatttgttgcattgaatgtgaaattggttgatataccagcatttccacaagaaattcatctgttagcacggtgcgtattttagcgaacgaataggcgtaacgggttggttacgaaggggggcgggggaatattgtttagacgatgattatatgctgatgaacggagaagcctcagcaggtatcagcgtagcagatttatccattgccattgcagacgattcggaatacaagcacatttgcttaaactctttactgggcgagtaggtaatttggtgtgaaaatatggtgtaggattctagaatattgagatttaccccctccccccgaaaaattattaatagcgttatttatttgtacacaataatggatatattgatatcgtcaggagaatgaatatgaaagcaagtgaattaaaaattgctgactttttaactagcacaaaagtacagtttactatccctgtatatcaacgtaattatgattggaaagttgaacaatgccagcaacttctaaatgatattttgagtatagggcaagattgtgatgtttctaatcattttattggaagtattgtttatattcacaataatggtgcttacacaagttcacaaattaaggagtggattattattgatgggcaacagagattaacgaccattatgttaatttatttggtgttatatcatctcacaaaatctcaaggaaaaaatgacttagctgacgaaattaatgaaactattctgattaataagttttcttctgcaccatataaattaaaacttaagccaacagataatcatgtttcagctatggaatatatttataaaggaaattttagtgaagggttgggttatttttcacgattggtggaaaattttaaatatttcaaatcttgtattactctagaaaacttagatatagtcagacaaggattagataaattaatgtttgtagaagtttcattagagagagggaaggataatccacaacgtatttttgagagtttaaattcaacgggtttagcattaagtgaggcagatttaattagaaattatatattgatggatttagaaagtgataagcaaaatatattcttccaatattgggatataattgagaagtttgctaaagatgatacaaataatgaaagtaaagtttctgactttattcgtgattatcttactaaaataaataaaaagattccaaataaaactagaatttatgaagcttttaaaagtaaatatcctagggtgcaggcggatgatttattagaattaaaacggttttcaaagtattatggtatattaataaatcctgaaagagaggaagatgtaggtattcgattacacttacaatatattaaattattggaggttaaaactgcgtatccttttttattaaatatttatcatgattacagttatttaaataaaattaataaggagcaattcattcaaattttagaatggttacagtcttttattattcgacgtctagttgttggactcccaacaaatgcattaaataaaatttttatggcactatataatgaaaatgagttagtagtatcagaaaattatgtagcaacaatcgttaaatctttgtcaaaacgtacaaataatcagcgttttccgaatgatgttgaggtgattgaggcattaaaaaattgttctatatataattgggcttctaaaaatagaacctatttgtttgaaagactagaaaactttaagaataaagagtttatatccattataaataataaaaaaattagccttgaacatatttttcctcaaaatgcaggtgatgattggtatgaggatttagattcgcagcaatacgaatttatgcaacagaaattacatactttggctaatttgactttaactggatataattctgagctatctaataaaagttttatcaaaaaacgtgaattgtacaaggatagtcgattatggttaaatagctcattaagttctctatcgaaatggggaaaaaatgagtgggaagatcgatttactttattatcggaacgttttcttaatatttggaaacaacctgaatatgaagagcaagactcagaaattaatttaatggatgtaaatgatttaacctataggaaattgatttcagcacaattccaagatattcagttagaggttaataatgttacagagctttatagagttgtaattgaacaattattccaagaggaacctactagatttttagaaacccaattggctgaaaagttacgtattgttccagatggaaaaaaagacgaactacgagtagcagtagctttacctaataactaccaaatggaaactaattatagtaataatgataagttagctcgattaaaacaggttttaattaccttaaatttagaaaatgaattatttattcgtttagattcatttaataagaattaattgtaaagaaaaatgctctctctatgtattaatatatttttagaaatatttcgggagagcaaattatctttatcagactatataatacaatgtgtcttgtaaatatttaatacaatctcaccgcttgctatacatctaaatactccatcatactctccgccgcatcacgtccttcggcgatggcggtaaccacaaggtctgagccacgagtgatgtcgccgccagcaaagacttttggattggcagtttgttgtttgagttcgccagtcgttgcaattctgccacgattgtctgtggttacgccgattgaggcaagccaaggcatttcgtgtggggcgaagccgaaggcgatgataacggcatcacaagcgatgatttcttcactgccttcgatgatttcggcttgacggcgaccgttggcatcgggctcgcccagttgggttttgatgattttaatccctgttactttgcctgattggtcggtttcaacggctaatggttcggcttcaatttctacgggttgagcgttgaattggaactcgacaccttcttctttggcattgctgtattctttacggctacccggcatattgtctgcgtcacggcgataaacgcaggtgacttctgctgcaccttgacgcaccgatgttcttacgcagtccattgcggtatcgccaccacctaagaccaccacttttttacctgccattgaaacgtaatcaggggccgctaaaccgagcaaatgttgtgtgttgccgatgagaaatggcagggcggaataaacgccttgtgcctgctcatttggaatattggctttcatgccttgataggtgccaacgcccaagaaaaccgcatcatattgagcaaccaaatcatcaaggctgatgtctttgccgatttctatgcccagtttaaattcaatgcccatctcgctaaacatctcacggcgacggctcatcacatttttttctaacttgaatgatggaataccaaaggtgagcaagccaccgatttctcgttggcgttcatacaccaccacatcaacaccgttgcggattaacacgtctgcacaacctaatcctgctggacctgcaccaacaatcgccactttcttgttggctttaggaacatttttcactgttggtcgccagcccatttcaaaggctttttcggtgatgtatttttcgacattgccgatggtgaccgcaccaaattcggcatttaaggtgcaagaaccttcacacaagcggtcttgtgggcaaacacgtccgcaaacttcgggtaagctgttggtgctgtgtgccagttctgcggcatcaataatgcgtccttcttgtgccaaacgtagccagttgggaatgttgttgtgcaacggacatttgtgttggcaataggggttgccacactccagacagcggtcggcttgcgactctgcctgtgcttggctaaacatttggtaaatttcgataaactcgcttttacggctgtttaatggaatttttgacggatcaacacggggtaaatctataaattggtaaacattatcacggctcatttttgtgttccttctaataatcctcctctctagcaaagaggggttaggggagattgggcagacgaaatgtcgaagtgagagatttgtatggttctcatcattctttaattcgcattttgtcttcgttatccctttttaacaaatctccccctgcccctctttgctaaagaggggagcttgttcagagggaaattggcattttcatcttttcactttctactgcacaatcacacccaactcatctagggtacggcgtttgtgtcctagtagggcattaatgtcattcgctttaggtttcaccaagacaaagcgtgcgacataatcgtcccagttagcaaggatacgttcgccaatcgcactgcgagtaagttcaacgtggcgagagattaagccacgcaaatgctcttggtgagttggtaaatcgcaaatgcttagtccttcaaccagttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatgcggttggcaaatttgccgtctgcatcgaacacataggcaaaaccgcctgtcatgcctgcaccaaagttaatccctgttttgccgagaatggtaaccacaccgcctgtcatgtattcacaaccgttgtcgccaatgccttcaactacggctaatgcacctgagttacgcaccgcaaagcgttcacctgcacgacctgatgcaaagagttctccccctgttgcaccgtaaaggcaagtgttgcctgcaatagcggcttcttcggctttaaaggcaacgccattgtgcggtttaatcacaatgcgaccaccagccatgcctttgcccacatagtcgttggcatcaccagttaagttcaggttcacgccgcctgctaaccacacgccaaaactttgtcctgctgtgccgtttaggttgatgctgaaggtttgcaatggattgccacgattgccatagcgttgagccaccaagcctgaaagggttgctcccacagagcgatctaaattgctgatgtcgaaatccaaatccgctgataaaccgctttcaaacgcattttgggcttgtgccacaatcgctttattcaacaaaccttggtcaaaagcagggttggcttgggtgcagaaacggctactgccgtctggcacttttggcgaatagagcaatttagccaagtctagaccttgttgtttagcggttttgccattgatgatttctaataaatcggtgcaaccgattaagtcggttaatttctctacgccgagttctgccaaaatttcacgcacatcttgggcgatgaatttaaagtagttcatcgctttttcaggtaagccgtggtaatgctgattacgcaaagtatcgtcttgtgttgctacgcctgttgcacagttgtttaggtggcaaatacgcaggtagcgacagccaagtgcaaccataggtgcagtaccaaaaccgaaactttctgcccctaaaatcgctgcttttacaatgtctaaacctgttttcaaacctccatcgacttgtaaacgaactttatgacgcaaattgttttccaccaaagcctgttgggcttctgccaaaccaagctcccacggtgaaccgcagtatttcacgctggttaatgggcttgcacctgtgccaccatcatagcctgcaatggtgattaaatccgcataggcttttgccacgcctgtggcaatggtgccaacacccggcaaggaaacgagtttgactgagattaaggctttcgggttgatttgttttaagtcgaaaatcaactgtgccaagtcttcaatcgagtaaatatcgtggtgtggcggcggtgaaatcaaggttgaacccggtaccgcatagcgaagttgagcgatatatggggtaactttatcccctggtaactgacctccttcacctggttttgccccttgtgccactttgatttggatcacttcggcactcattaagtaagcaggggtaacgccaaagcgacccgatgccacttgtttgatttttgatactttttctgtgccataacgtttcggatcttcaccgccttcacctgagttggaatagccacccaagcggttcattgccactgctaaggcttcgtgagcttcggggcttaatgcaccgatagacattgccgcactgtcaaagcgtttgtataagttttccgcgggttcaacacggtgaagctcaatcgctttgcctgcttcggtttttaaacgcaacatatcacggatcgtggtaatcggacggttgtttaccacatcacggaaggctttgtatttttcataatcgcctgtattgactgccgtctgcaaggtgttcaccacatcagggttgtaagcgtggtattcgccttgcggtttgtatttgagataaccgcccatttcaatatcttggctgtgtcgccatgcacgtttacgacaagcggtctgttgttgctctaaatctgcaaaactagccccttcgatacggctggtgataccagggaagcaaaggttgatgacttcactatttaaaccaaccacttcaaacaatctggcacaacggtaggacgacacacaagaaatgcccattttcgacataatcttgtataagcctttgttgatcccgttgcggaagtttgccattgccacacgaagcggtttgttgattgcccctttttgcaccatatcggcaatggtttcataggcaagatagggataaactgctgttgcccctaaaccaattaacaccgcaaaatgatgtggattgcgtgcttctgccgtttccaccaaaatgttggtatcacaacgcaagttggcttccaccaaacaggtttgcaacgcccccaccgctaaggcacttggaataggttggcgttcagccgtgatgttgcggtcggacacaatcaacaacacggttttttcacgcaccgcttgttttgcctgctcgcataattgctcaatcgcctgttttaaggtcaattcatcaggattaaaggttgcatctagtatcgtgtgtttgtagtgttccgcaggcaaacgcaaaatctgttgcatatcggaatagaccaaaatcggtgatttgaaattcactcgatgcgacatgccttctgcttcaaagaacacgctcatttcacgcccgatactggtggcaaggctcatcacatgggcttcacgcaatgggtcaatcggtgggttcgttacttgggcgaagtattgacggaaatagtcaaacagcacacgtgggcgttcgctcaacaccgcaaaaggcgtatcatcacccattgaaccgaccgcttcctgtccgctctcaccaagcacacgaataacattttccagctcttccttatcataaaggaactgcttttgatacactttcagttgtaactcatcaagtgtcgcttcacccacttcgttttcaggcaactgctcaaagggaattaaacgttgaacgtgtttgtttaaccactcacggtaagggtgtctggctcgcacttcattgtcaatttcatcagaatgcaccaagcgaccatgtttggtgtcaatcaccaacaactgccctggtccaacacgtcctttctctaccacttcatcaggggcatagttccaaatccccacttcggacgcaatcgtaatcaagcggtcttgcgtaatcacataacgagcagggcgtaaaccattacggtcaagattacaagcggcataacgaccatcggttaaaacaatcccagcaggtccgtcccaaggctccatatgcattgagttaaaatcatagaaggcacgcaaatcatcgtccatatcaggattttgttgccacgcaggtgggacaagcaaacgcatggcacggaataaatccataccaccgctaacaaacagctccaacatattatccaacgagctagaatccgaccccgtttcattcacaaaaggagctgccgtctgcaaatcaggaattaacggcgtacgatacttatacgccctagctctcgcccaagcacggttgcccgaaatcgtattgatttcaccattatgggcaagataacggaacggttgagccaacttccaacgaggttgcgtattggttgaaaaacgttgatgaaacaaacaaattgccgtctgcatacgcaaatccgccaaatccaaatagaacttcggcaaatctttcggcatacacaagcctttataaacaatcgtttgattagaaaaactacaaatatagaaatcagggtgattgatacgcttctcaatacggcggcgagccacaaacaaacggcgttgcaaatcctgcacacgccaaccgctaggtgcattcacaaacacctgcttaatcgttggcatatccgccagagcaatttcccccaacacagacggattaatcggcacatcacgccacgcaggaatacccaacgtttcctgggttaattcttcattgataatctcaatatactctttgactaaggcttcatcacgtggcaaaaaaatctgtccaacaccgaaaatttttgccaaggtaaaaccgctttccgccgcaaccgcacaaaaaaagctctcaggcatctgcaaagaaagaccacaaccgtcccccgttttgccgtctgccaaaatcgccccacggtgctgcatacgggataaacctaaaataccattacgaaccaccttgtggctctgcaccccatctatattggctatcaagccaaacccacaattctcacgctcaaatgagctgttataaagttttgtcattcaaatcacttcctagttatttctttttaaatcggtaagtggtgtaagcatattagaaaaattaatgaaagacaatagattttttgattgagcatgatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagataccataagacacaacaaattttatttcataaatgtgtctaaattaaatgctgtctgtttttgcaaaacagcctgtgcaatagtgactaatttacgcattaaagccgtgataatcaccattttaggtttgccgcattcaagcaatcgcagcacaaacgagcgatatacgctgtttttgtagctgccaaaggcaaagttcattgcagggcaaaagagtgccttacgaatgtcggattgcccgatttttgaaataccaataacggtatttaaacttttcctggaacttttaatcatcggggttaaacctgcaaaagtggcggctgctttcgcgtttttaaaacgatttccatcacctaaatgggcaatcagttgaacggcggttgcaaagccaatagcaggaatagtgcaaagtaattttacattgtttttcaatgtattatctgcattaatgcactgtttaattgttttttccaaagccttaatttgcgctttgatgaaggtaatcatctgctgtgttgaagcaatgcaatcgctgtcaagcaacattgttagccgtgttttttcttgtgccaactgttttttcaggtggtcaagttggcgatttttacgcaacaattcccgttgagcaggtgaaattggctgataaatcggtaatttatgacgcttttcatcggcataatcagcaagcatttttgcgtcgattttgtcggttttagagcgtaaattatcggttttcgtgaaatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcattacattgacgttagtcacagaagaagcaccggctaactccgtgccagcagccgcggtaatacggagggtgcgagcgttaatcggaatgactgggcgtaaagggcacgcaggcggtgacttaagtgagatgtgaaagccccgagcttaacttgggaattgcatttcatactgggttgctagagtattttagggaggggtagaattccacgtgtagcggtgaaatgcgtagagatgtggaggaataccgaaggcgaaggcagccccttgggaaaatactgacgctcatgtgcgaaagcgtggggagcaaacaggattagataccctggtagtccacgctgtaaacgctgtcgatttggggattgggctttatgtttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagctttcagagatgagagtgtgccttcgggaacttagagacaggtgctgcatggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtgattatcgaatgttctttaaaaatttggaaacaagctgaaaactgagagattttctgtaggggcaaatcacatttgccctgaaacaagaaagtctgagtagtaagaaaaatcttgactgaacaaaagcagtcaaatgtttagtagttaatatcaacttcaagtgaaaatgtttgaggttgtatggttaagtgactaagcgtacacggtggatgcctaggcaatcagaggcgaagaaggacgtgctaatctgcgaaaagcttggatgagttgataagaagcgtttaatccaagatatccgaatggggaaacccgatggatgaagaatccatcatttcattatgaatccatagtaatgaaaggcaaaccgggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgccggaagaccaagggttcctgtccaacgttaatcggggcagggtgagtcggcccctaaggcgaggctgaaaagcgtagtcgatgggaaacgggttaatattcccgtacttggtaaagctgcgatgtggggacggagaaggttaggttagcagactgttggatgtctgtttaagttggtaggtgggaagtttaggcaaatccggacttccataacactgagagatgatgacgagtttctacggaaatgaagtaactgataccacgcttccaggaaaagccactaagcgaaaggctttactaaaccgtactgaaaaccgacacaggtggtcaggtagagaatactcaggcgcttgagagaactcgggtgaaggaactaggcaaaatagcaccgtaacttcgggagaaggtgcgctggcgtaggttgtaggagtatacctccgaaggctgaaccagtcgaagataccagctggctgcaactgtttattaaaaacacagcactctgcaaacacgaaagtggacgtatagggtgtgatgcctgcccggtgctggaaggttaattgatggtgttatcgaaagagaagctcctgatcgaagccccagtaaacggcggccgtaactataacggtcctaaggtagcgaaattccttgtcgggtaagttccgacctgcacgaatggcataatgatggccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtacttccacgactaattaaatggtagcagttaccacaatttccactttccaattggggttagccaattttgcttcaacagcagctcttggcggtgcattaccttcagcaacccattcgtcccaagctcggttcatttcatcaaattcaatcatattgcttacaaaaacttgagccatcaaaattcgacttttatttgtgcctgcttgggctaaccatttatcaatttcggctaacacttgctttgtttgaccgtacatatcttgcgaatcatctttagggacttgtcctgcaagataggctacaccgttataaattgccatttcagataggcgtttaccgacttgaaatcgttggatcattgtttctcctaatgaaagcggtgagtagatagcaaatttttgctattctctcactgcttgaaaatgaattactcgactttgacaatccagccttcaggtgcctctacatcgccaaattgaattctggttaattcagcgtataaacgtttagtgatagggccaacttctgtttcagaatagaatacgtggaagttatccccattttgaataccaccgataggggtaattacggctgcggtaccacaagcaccagcctctgcaaactgatctagttgatcgatataaacatcgccttcaatcgtttccatacctaaacgctctttagcgagatgaagtaacgagtattttgtgatacttggtaaaatagacgatgaagcaggggtaataaatttgttatcttttgtaataccaaagaaatttgccgcaccgacttcttcaattttagtatgtgtttttggatcaaggtaaattgcatctgcgaatttacgctcaacggctaattcgtgaggcaacaggcttgctgcatagtttccgcccacttttacaccgccggtaccgtttggtgcagcacggtcataatcagacacaaggaaattcgctggagctaagccacctttgaagtaagcaccaacaggcacacaaaagacagagaaaatatattccggtgcagcacgaatgccaatattttcacccacaccaatcacaaatggacgtaagtaaagcgttgctcctgttccataaggtgctaaccattcttggtttgctttgacaacctctttacaagaacggataaacatttccactggcacctgtggcattaaaaggcgatcacaggtagtttgcatacgtttggcgttttgagctggacggaaaagattaatcgaaccgtctttgcaacgataggctttcaagccctcaaaacattgctgaccatagtgcaatgcagtagaaccttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgctgtcggtagttaattccccctcattccatttgccctctttccaatgtgcaataaaacgataatctgttttgatataagaaaatccgaggtttgcccagtcaatatttttagtcattgttgtgtcctttatttttttatatgagatatgagaaatttacaacgtttctaaagaaaaatgaatgttttcaatgaaaaaaataggattttttatcgaaagtgcggctttgggtggcaatttttgtatattctggtagaatagtaggaaattctgctataaaaaaccgcccaacatgggcggtagctaaaccaaaaggttcaaaatatacaggaagtgaaacgagtaacttttttgttactctagtctagtttcctagaccaatatgcaaacacaacatcatacttaaaattcaaaaatagctaaaagacagctatcactatccatctaagtatggtgctgaattttagagatgtttgaccagttatacaaacgagattttttaattttatttatcaaaaaaagtaatctaaaaaaactcactttttctagtaaaaattatgaacaataaaaagttaccgccactcaatgctctcaaggcatttgaatctgctgctcgtcatcttaattttacgaaagcagcagatgaactatttgttacccaggccgcagttagccatcagattaaattacttgaagattttttaaatattcaactttttcatcggaaaaatagggtgttagaattaacggaacttggtttgcaatattttgatgaaattcgtccgctattagagcaaattgctaaagcaacggataaaattcgttctaaaaataatagacaaattcttacaattagtgtgcctcaaacttttggtatgcattggcttgttcctcggttgagtaagtttcatgagcggttcccccatattgaggtcaggattaaaggtgtagatcaagatgaggctcagcttggaaaagaaattgatgttgctatttattatggttcaggtaaatgggagaatgtggaatctattcgcttaacagaagctccattagtaattttagcttctcctaagttcttagaggaaaatccgttaaaatcaccaaaagatctgattggaaaaacattattgcatgtatttagccgtaataaatggaagcgaacgattgaatattttggtttaagtgaacaaattgatgttgaggaaattggtccaatttttagtcatacatttatggcattacaagcagctttgtatcagcaaggtattgctattgccaacaagactattgctcagcatgaattagaacaaggaaatttaattgagcctttttctacaggattaaatgatgaaaaatcattttatgttgtttatccatctcaaatatcagacaatcctaaagtacagcattttgttgattggattacgaaagaaattaatatatctgagtagtataataactcaagaggaaatatgaagtatcagtggattttatttgatgcggatgaaacgttattttcatttaattcatatttaggtttacaagcagttttagcttgttatggtatagagttttcccaagatgattatgaagcttttcaagctgtgaataagcccttgtggcttgcatatcaaaatcaagaaatcacaattgaacagcttcaaatatgtcgattctctaacattgcaaaaaaaattggaaaagacgaattagctttaaataatgaattaatgttaaaaatggctgtaataagtaaaccattatctggaactatagaggtattagaaaaattgtttggaataattagaatgggaattattacaaatggtttagaaatattgcaaaagaagcgtctggaaaatactaatacagaaaagtattttgatattgtgattagttcggaggttgcaggggtgccaaagccagatgaaagaatttttaagtttgcttttcaacaaatgggagatataaataagtctagaatattgatggtaggagatactctttcttctgatattttaggtgcaaatcaaataggtattgattcttgctggtttaatccttgcaaggaagttaatcatacagaaattaagccaacttatgaaattacggatttaaagcaattacttaatattgtactaagttagaaataaaggatatatacgtgaaattacagcagttacgctatattgttgaaatcgttaatcaaaatatgaatattacagaagctgctgaggtactttatacatctcagcctggaattagtaagcaagttcgtttgttagaagatgaattaggtatacatatttttgaacgatgtggaaaacatattaaagcgcttactccggcgggggaacgtattattacaattgctcgggagatgttggcacaagctcaagggattaaatctattgcagaagagcaaacaagtccgcataagggaatactcagaattgcaactacaaatacccaagctcgttacgtattaccaaagataattgaaaaatttaagaataaatacccctccgtaagtttacatcttcatcaaggatctccaacacaaatatatgatgcattaatggcaggagaggttgatttagctattattacagaggctcaatatctttttgaaaatgttattctgttaccttgttacatgtggaatcgttcagtgattgtaaaaccagatcatcctttggccaagctaaataagggaaataataaattaactattgaagagttgggacaatatgatttaatcacttatacatttggttttacggggcgctcagatctggataaggcttttaataaacatggtattctacctagaatagtatttacagctactgatgctgatgttattaagacctatgttcgttctggcttaggtattggaattatggcaactatggcatatacgaaggaagacaaagatttagttgctattgatgcaagccatctttttcaatctagtatgacacaaatagcttttaagcgaggtgtttttttacgtaattatatgtatgattttatcaattatttttctgctcatttaactaaaataaaagttgaagaagctgagcaacttcgtgataataatgcgattgctaggctttttgagtacgttagtttagaggaaatttaatgaatgcattaaaaaattagaagtattaattatttcttttatttgtattgttcaatctataagggcagaagagtttcatatcaagtataagtctaattatataatgccgacatatatccattttaaaaagagtgatgaatattattcaataatatctaaaattaacattcctttatataatatagtatttaatacaggtggtaaaatacaaggtaaacaatttaatatgttgaattaccaagatataagaaatgggaaaacttatgctaaggcagaggttaagggaacagtaattcaatacgggaaagtagtagaaccacttaaacaggagatcttaactttaccaacgtttgatttattttctattgcatttcaactcagctattatggagtattaccgtataattttcaaacgacaaatggtaaaaaaactttatccacataaggatacgattgtaaatgaatctagagctattcttagaataggagaaatagatgttgaggaaataacttacagattcaaaacgggtgctaaacagattatagtgaagaaattttcaggtgaaaaaatttcctcgttatatttcttataatagggatggggataattatgagttaatttttgatagttttttgaactaattttaactaacactagttctgattaatcattattgacatatatgtaatatattagagttgcaaaaaattattaagcaatgtaaatttttgtgaaaagtgtaggagatgtcacatttttctatttttcttgatgacaacgtttgggaaatcagtagagtagttgcttatccatcttatggcttttctttgaacctttagtattatggacgatagttatatatttcccttaagctccccaataattcggattttacaaattaccgattcacatttatttgcatcagatacttgtgaactattaggggttaataccactcaaagttttcaagctgtgcttaatatgatcatgaaagaatcatttgagtatgacttgattcttgcaacaggcgatcttgttcaagaccataatcgagaggcatatcatcgttttgcaaaaatggttaaaccgttggttaaaccactcttctgggtagctggaaatcatgatttacaaccacagatgcgtaatgctttgtctatttattctcaaattaaacctgaaaagcatattttagttggtgatcattggcagataattcttcttgatagccatattcaagatagccctaaaggtagattagagtcttctgagcttgcttttttaaaaagaaagttggaagtccatcctgaacgatattctttaattgttttacaccataatattctgccaacaaattcagcatggcttgatcagcatagcctttctaatgtaaatgatctacttgctacattaaaagcttttccgaaagtgaaggctattgtacatgggcatattcatcaagaggttgatgctcaatggaatgggtatcgtatattatcaacgccttcaacgtgtatacaattcaaaccacattgtaatgatttcacattagatgcgattcctcaagggtggcgtgagctttgtttaaatattgatggctctattgatactgtggtaaagcgtttagataacaacaattttttacccaattttaaagcattgggatactagagaaatttatcctttttaagcagccattaagattaggagtaatagacaaacagttgttagaaatatttattctcaattattttgtattctatttctattcaatttgatttttgcagcgtccccctttttgtaaacagcagatattatacagtgtcacatctgagatattcatcaatgcttcttctgttaaaaatgcttgatgccctgttaaaagcacgttatggcaagaagacaaacggcggaaaacatcatctaaaatcacttcatttgatttatcttcaaagaaaagatcacgttcgttttcataaacgtccatacctaacgcaccgattttacgacgttttaatgcttcaatcgcttcaggagtatcaattaatgaaccacggctggtattgatgatcatcacgctgtctttcattttgtcaaaagcctctttattcaacagatgatagttctctggcgtagctgggcaatgtagggttatcacatcggacttagcataaagttcatcaagtgtgacatattttgccccaatttcttccacaataggatttttaaatgggtcaaaggcaagaatattcattccaaagccttttaaaattcgcgttgttgcaataccaattttccctgtgccaatcactccaacggtacgtttgtacatattaaatccgattagcccttcaagagagaagtttgcttcacgggtacgctgataagctcgatgaatacggcggtttaatgtcatcattaagccaacggtatgttcagccacagcttcaggggaatacgcaggtacgcaaacaacttgaataccaagttctttggctgcttgtaagtctacattattaaagcctgcacaacgcaaagcgatcattttcacgcccacttttgccagtttctcaagcactgctcggctaccatcgtcatttacaaaaatacaaacaacatcgcaaccttccgccattttagctgtacgctcattgagcataaaatcaaaaaattcaaactcaaaatggtattgttgattagctatttcgaggtattttcgatcataatttttggtactaaaaacggcgactttcattgtgctttcctaaataagtttatcattcactaattcaaatgcattagatagttttattgagaattcttgaggagtatatttatctattttttctttccatattctaatcatctcatatctatttgttaagctagtgtcccaacattcagaaactaaagataaatcaatacaattcaatatatgtttaatacgagccacatacttaaacaaaaaattatagtgtagtttagataattcatgagtacctaaaactttaaaaataaattttagatcttcatcaatatcctctattctcttttttcctcctgcagaatattgatctctcatatttggacaaataatagaatagtaagaaacccaaaatgcacatagtctcgaataatttgaattaaaaacttcagggtaaaggataaatccctcagcaataagatctcgtttttgctctttttctaagtttgtaaaatcaataatttcaaaatttctactaaaagtactttcctcatcaatccaccatagtgaattatcttttcctaacttagatttataatatttcttaatagatttaactggttgttcctgatttcttaattcatcatatgatatattcattaagtcaaaaatagattcacctttcggtaaattcatatctatttcatatctaggataatgagtaacagaaattccaaataaacaatcctcataagttctgtacttaatatcgggtattcctccacacttaccaaagaacatataaattttctttacacactcaattctagacgattcaagtacactattgcctatggacttccatttatcatccttagtaaatttaacctcaactccccagtaattatttataacaatatcagggaaatctctgtctgctgtacgatataaattccctttaaataaagtaccatcagcacaaacttgcatacagttaaaaaccaaactttcaaatttgttccctgaatttattgatggatctaaattttttagtaccagatcacgagttttatctaataactcttcaaatttctgtttttcatttatatccgctgtagtataaatcatttcagggtttcctttacagattgagcaagatgccatgcaaatacaggggctactgcattgcctacctgcctataagcatcagtcgtcgaatttaaaaactcaaagttatctgggaacgactgaatacgagctgcctctctagcagagagcctcctcggcaagctatagtgaaattcaatatttccatgatgctcagccctcattgttggacctgggcgatccgcttttgttttggtgtttccttgagttccttgaaataacttagctttagaatagccactatttggtagagaaaaatgtttttcatcattttctaaatcaccgattgccctttttaaatcaacccatttttctgtagattgaaataaatcctcgctatctgaatgagtttctcggggaaagaaaaattctgatgtcaaatcattgcgaacaccgacaattattaccctttctcgagtttgaggaacaccataattagctgtattcaatagttggtatttaattttatagccaatctttccaaaatcttcgacaatagtatttatagctaaaccattttgccatgtaagcaatcctttcacattttcagctaaaaatagtttaggctttaccttatctacaacatcaaccatactgagataaagatttccacgttcaaccgctaatccttgtcgctttccagctaagctaaaatcttgacaaggaaacccacctagaacaacatcagcttcaggcaatgtacttttatcaactagtgtaatatctccacatactacgggagtttcagggaaattatgttttaaagtcttacaagctttttcattaatatcgttcgcccaaaccacttcgaagggattttcatcgtatcttttatttaaaaagtcaaacccacctttaaatcctaaatccaaccctccagctccagagaataacgaaataactcggaatttcttactcatatatcccttacacttgaacaatatcaatacgattatgctgttctgccactcttgctcgaattttcgcttcgagttggtcgatcaatttatcattgtcaaaacgctctttttgacgaacgccatcaagataaaaaccgctcattttatttgagccggtcacgccaagatcagacactaacgcttcacccggaccattcaccacacagccgataatggatacgtccatcggtgtaataatatcttccaaacgttgttcaagggcattgaccgtgccgatcacatcaaattcttgacgagagcaagttgggcaagcgataaagttgatcccacgagaacggatacgcaatgattttagaatatcaaagcccactttgatctcttcaacaggatctgcggctaatgaaacacgaagcgtatcaccgatcccctctgaaagtaataaacctaaaccgattgctgatttcacagcccctgctcttgcaccgcctgcttccgtaatgcctaaatggatcggttgtttgatcgctttagctaacaagcggtaagattcgacggctaaaaagacatcggacgctttcacactcactttaaattgatcgaagttaagacgatctaagatctcaacgtggcgaagtgctgactctaacagggcttctggcgttggctcaccgaatttctcttgaatatctttttcaagagagcctgcatttaccccgatacgaataggaatatttttatctctcgcacagtccaccaccgcacgaatacgctcttccttgccgatattacctggattgatacgcaagcaatccacaccatattccgccactttcaacgcaatacggtagtcaaagtgaatatctgcgacaagcggtacttttacctgctgttttatcaatttaaaggcttctgctgcgtccattgttggcacagacactcgcacaatatccgccccgacacgctcaagagctttgatttgtgctacagtcgcttccacatctgtggttcgtgtattcgtcattgattgaacagcaatcggtgcatcgccccccacaggcacattaccgacataaattttggtcgattgacgacgcttaataggtggttcttttaacatattattccgctaaaggtaatttgaaacgtgcaactcgtccatctactttcagtggaacaacttgccctttgtaataaattttgacgttagcaggcgcccccacagttaaacgatattgttcgttattgttaaaacttaatacttcacctgccttataaagtctttctgctaagcgtttgttttgtgcagtacgcacagtaatccaactttcagcccccgtaatctcaatccgcagttcttcctctactgccgtttgtgtaggttcttccgcttgattatttgcttctgtttgtgtaagcacaggctcagtttgcacagattgaactagctcagcttgctctacggcaacaggcgtgctgctctctgccactgctgtagtagtggcagtcgtttggttctctgaagctacttgagctacaggctcttgatgattactttccactgctggtgttgcaggttctgcatttttagcaggcaatgttaccgcttgcggaacttctgctggggttggttgcggttcaaccggtgtcacttgaggctcttcggcaactttagctgttgcttcagtggtgttcacaatcaactgctcacggttagcctgatctttctgatgctcttgccaccaccaagccaacgtcataccaacggcacttaacaacacaatccacgtcagcccttttacccaacgcatttgcgacttatggtttttaaccgcaatcggtgcagcttttcggacttcttttggaattgtcacttcaccgtaattcactgaatttacaagggtttcaggcaaacgcagaaaacgcacataattacgcacataaccacgcacgaaagctggtggcacgcttggcaaaataaaaatatcattctctatcgcttcgaggtggctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcagatttgtttttcgagccacgtcctaaagaaagtgtcattgtttccgtcattgtcattgctttttctatataaaaattaggtgagaagtttaaagaggtatagcttgttttgcaatcctcaattcattaatcaaagcgaatttccctaaattagctagagtatacgaacgccatttgtgacgctcgctcaacttacttcacactaccacaatttaaacagtagagataactctgcttaggatcattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgccaacataccaagctgttgctgagtttgttgaggcaaaggcaaattcaaccattcaacagcttttaattgtaattgcaatttgaaatcacgcattacttggcttatcaaatcatcactttcatcaattagccactgtgtgctaaagcgttcgatttctgtttcccctttcgctttacgtttttcattgattaagattgttaaagcgtgataggcatcatcaaaatcgcccaactcatcaaccaaccctttttcaaatgcactttccccaagccaaacttgcccttgagccactttatctacatcacctttcgacatttttcgccccttgctgactaattcaaggaaacggtcgtagccattttcaatgctaatttgaattaactcactttgctcttttgatagcgattttaatgctgtttgttgtgcaaaaggcgatgtactaacaccatcttcattcacacctagttttttcgccgttttctcaaaactgacagctaaagcaaaaataccgatagagcctgtcaaagtagttgggcttgcaatgattttatcacttgttgccgcaatccagtaaccacctgaggcagccattccgcccatcgatgccacaacaggtttgcccgcttgttgcaaatcctcaacctcttggcgaattaattccgatgccattgcactcccacctgggctattaatccgcaatactacgcctcgcacgtcatcatcttcacgagcttttctcagcaattttacaatcgtatcactgccagcaacttcatcatcgctttcccctaacacaatcgccccttcaacattcacaatagctattttatccttgcctaccacattaaagcggtcagataacgacaaagaatagtcaaaaaagtcgatatggttatagtttccgtcttgatcttcaccaaattgctcaatcaagtcgaggcgaatttgacgatgcgttgccacgttcgttacccatttttgcattaaggcgtattgagcatcatcacctttcacagctttatattgagcgattaaacggtttgcttctggcactattgtgtttgcatcaatatggcgatttttagcaatcgcactgctgaaatttgcccataattgagatagccataattgagcattttgacgagcttctgccgacatatcatcacgcagaaacggctcaacggcagacttataggttccaacacggaaaatatgcggaacggcttcaatcttgtctaataacgatttgaaatagagtgtggaataatttaaaccgtgtaaatccacaaacccagctttgttcagataaattttatccgcataactcgcaaggtaatattgttgttggctatatccttcaccgattgcaatcacaggtttatttgattgtttaaaacgttcaatctctttgcctacataggttaaagaaggaatatcgcccccttcaaaataacttaaatcaagcactaatcctgtaattttttcatcatactgtgctttctttattgcacgcactacatcaaaggttgatattttaatcggttcatttctaccgcctaattcagaacgtaaaaagcggttaaaatcactaaattcatcgtgattatccgctaaataaccatctaaattgagcaataaagcccctttactaaattcgacaggtgttttgctgttagcagcatcacttgaccataacgccataaaagcaaatcctaacatcacaaataaaataaataccagacttatcacaaattctcgaatacaacgaaatagatgataagcccctttgagtagatgtagcataaaaaatccttagaagtgaagagggctattaagccatcataaaatagtaaggaaatataatcctttcaaaaactagatttgattgtgcttttgtaagaatagatagaaatatgtctctttaataattctatctgattttttctttgaaatgaatatttggcagaatgaacatttagttttagaatgggaaactatgattgatcagaaagtataaaaaatggcaaataaaaatcctttttctcttgatgatataactcaagaccactctacttggcagacatttaaacgcctatggcctatgatttccctttttaaaatagggattattgtggcgatggtggcaatgatatttaacgctgctgccgatgcatacttgatcacaatgcttaaacctttgattgatgaaggctttggcgttgactctgatcgtaactttttaaaagtgatggcatttattgtcgtaggcttaatttttgctcgtggtatcaccagctttatttctgcctactgtttggcgtgggtgtctggtaaagttgtgatgacaatgcgtcaaaaagtatttaagcatttaatgtttatgcctgtaacattttttgaccaaaactcttcaggaagattactttcccgtattacctatgattctgagcaagtagcaagttcttcggcaaatgcgttgcaaagcgtggtccgagaagggatctacattgtctttctcgtcacaacaatgttttattatagctggcgtttatcccttgttcttttcatcattggtcctgtgattgcggtattaatccgagttgtgtcaaaacgctttcgtaaactcagccgtaatatgcaagaatctatgggaagcatgaccgaaagtgccgaacagatgttgcgtggacataaagtggtgttatcgtttggcggacagaaagtcgaagaagaacgcttcaaccataccagtaacgatatgcgtcgcaaaggaatgaaaatgatggcagcaagtacgattgccgatccgattattcaagtgatcgcttctctagccttagcggtggtgctttttgtcgcaggttcgcctgaaattatcggcgatgatttaacagctggggaatttgccgcagtgattggggcgttaatgggaattttacgtccattaaaaactttaaccaacgttaatgcccagttccaacgaggaatggcggcaagccaaacgctctttaccttatttgatttaccaacagaaaaaaatgaaggcacttatcaaattgaacgagccaaaggcgacattcgttttgaaaacgttacctttacttattttggtaaagaacaacccgctttaaaaaatatctcgtttaatttacctgcagggaaaaccttagcgttagttgggcgttcaggctcagggaaatcgaccattgcgaatttgattacccgtttttatgaaattgattcgggcaatatttatcttgatgatcataaaattcaagagtacaccttaaacaatttgcgtgaacagtgtgcaattgtttctcaacaggttcatctatttaacgacaccattgcgaataacattgcctatgcagctaaagacaaatacagtcgtgagcagatcgaagctgcagctaaagccgcttatgcgatggaatttatcgaaaaaatgtcacaaggcttggatacagtaattggtgaaaacggggtaagtctatctggtggacagcgtcagcgtttggcgattgcccgtgccttattaagaaattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgttttagtcttagatgaagctacttcagcgttagataccgaatcagaacgtgcaattcaagcagcccttgatgaactacaaaaagatcgcactgttttagtgattgctcaccgcttgtctaccattgaaaacgccgatgagattttagtggtggatcagggagagattattgaacgcggatcacacaaagtcttgctggaaaaaggtggtgcttataaacagctatatcaaatgcaatttagtgaataatatacattctaataatttagagagattaggttgaatagtaaattttgtgagctagttctcagaaatataatttatgttatgcatttcttacaaaatttagatagaatacaagaaatcagactatattctaggagttattatgaattatccaatacttataaaccaattaaaagaagaatttttcagtggctggaaaccctttgaggtagcttggcttttcttatttattgcagctcaaattggcgtatatatttactaccccgattctatcattggaatggtggcaggtatttcaggtattatctgtaatgtttttgttggtaaaggaaaaatcagtaattatttctttggtttaatttttgcatacagctatttctacgttgcatggggggcaaatttccttggtgaaatgaatacaacgctctatgtttatatccctgcgcaatttataggctatttcctttggaaacaaaatatgcaaaaagccgaaggaagtgaggcggtgatcacaaaagcattaactattaagggatggactggattattaacttttatggttattggaacattattattagttcaagccttgaaggccgctggcggtagttcaacaggattagacggtttaactacaattattgtggttgcggctcaagcattaatgttactacgttatcgtgaacagtggctattatggattgccttaaatattctctctatcgttctttgggctgaaaatccatcaatgtacataatgtattctgcatatttattaaattccctttatgggtattataactggacaaaactacaaaaagcctaataaataaaatctcttataaatcaaaggttgagacttctcaacctttcgtttttccgctatccttggcaaaaatttttttcttagataacacattgcaactgacattaccgatccatcaaattgatgatgatacttttgacaacttttacgccgaaaacagtttattgctgttggggtcgctacgccaaaattttgtggatgttcagcaaccttttttttatatctggggcggtaagagcagtggcaagagccatttactcaaggcggtgagtaatcattatttgcttaatcaacaatcagcaacctatattccattggataaatcccattacttcgcccctacggtattggataatggggatcaacttgatgtggtttgtcttgatgatatacaagcggtggcaggtgatgaagagtgggaattggctattttcgatctgtttaatcagattcgtgaacagcaagggttgtttaatcaaggtaagaaaacattattgttaatcagtgccgattgtccgccacatcaattagctattcacttgcctgacctgcgttctcgcttaacttggggcgaggtatatcgtttggcggatcttgatgatgaacagaaacgcattattttgcaacgtaatgcacgcaataaggggctagagctttcagatgaagtggcgaactttttactcaagcggttagatcgtgatttacaagccctaatgcataaattaatgttgttagatcacgcctcgttacaggctcaacgtaagctcacacttccttttgtcaaagaaattttaggactataaatggatcaactttcgctcattaatattgcttgtgaacgtggtgaaactcgcttgtttgaaggctgttcattgactatttcgagtggtcaatggtggcaaatcgaagggcataatggcattggaaaaaccagtctattgcggattttagctgggcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcggattttagctgggcttgcagtggcggtagaaggcgaggtgcagtggaatggtgttaaaattcagcaacaacgagatcaatactacactaatctcttttatttagggcatcacgcaggggttaagcctgaactgaccgcttgggaaaatctgcgttttttccaaaaaattcaagggttgcctttagatgatgaagccctttggaatgccttaggaaaagtgtcgttgattgggcgagaagatttgccttgctcgcatttgtcggctgggcaacaacgtcgagtggctctggcaaaattatggctgaccaaagcgacgttatggattttagatgagccttttactgcgattgataaaaaaggggttgcggaactgatcgcccatatcgaacaacattgtgagcaagggggtatggtgatttttaccagccatcaaaccgcagaaagtaacaaagttcaagtgttatcgttagatccatttagagtataaaataaccctatgattttactgactattatccaacgagaattaaccatcgcctttcgtaaacctgcggaaattttaaaccctttatggtttttcttgattattatcacaatgtttccgcttttaatggggcctaatcctgaattactcgctaaaatagcctctggaactgcgtgggttgcggcggtgctttcagccttgctctcttttgagcgactatttcgtgatgattatttagatggttcactagagcagttgatgttgctacccgtcggtttgccgcaagtggcgttagcaaaagtgatcgcacattggctattaactggcttgcctttaattctgctttcgccgattacggcgattttactttctcttgaaacagaagtctggtgggcattggttttaaccctattgttaggtacgccgattttaagttgccttggggcaatcggggttggattaactgtcgggttgagaaaaggtggtacgctactcagtttattgatcttaccgctctttctacctgtattgatcttcgctgccgctgtgttagaagcctcaaccttaaatatgggatatacagggcaacttgctattttaggggcaatgttagccctcgcattaaccttttcaccttttgcaatcgcaggggcgttaagggttagcttacagtaacaagcggtaatttgaaccctattttttgtaataacttggagtttttatgtggaaatggttacacccttacgcaaagtctgaaacacagtaccacttgctagggaaggtgcagccttggcttgcagtcttaagttttttattgctgtcagcagcatttattattggcttggcattcgccccaaaagattatcaacaaggcgatagctatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcattattttcattcacgttccagcggcaatttggtcgatgggtgtttatggctcaatggcagttgctgcacttattgcagcggtatggcaaattcgtcaagcacatctggcaatgatctcaatggcaccgattggaatggtttttgcctttctttctctggtaactggggcaatctggggcaagccgatgtggggaacttggtgggtatgggacgcacgtttaacttcagccttagtattatttttcctctatcttggcgtaatggctctttattctgctttccaagataaaaatacaggggcaaaagcggctggggtactttcaatggtaggcgtaatcaacttaccgattatccacttctctgtggaatggtggaacacgctacaccaaggggcaactatcactaaatttgataaaccttcaatggcaaccgaaatgttaatcccattattattagcgatttttggctcaatgatctttatgatttggttaagcattgtgcgttatcgcagtgcattacttcaagacgaacgcaaacgcccttgggtgcgtgaactcgcaaaattaagtaactaggagagaatatgacctttcaatttgcatcacttagtgattttttctcaatgggcggttacggcttctatgtatggctctcttatggaattacttttctttctgtcggtctgttagtttggcaaagtaaacgtgaaattcgtcagacgttgcagttggtgaagaaagagcaggcaagagaaactcaacttagcaacaagcggtaggatattggataatattttcgaaggtaggcaagagcctacctttctttttgttaaaaatttgtgatataactcacaaatccaacatttgcttattttaataaattactgttttgctaaactaatttggtttattgatctacatcattttattttgtgggggctttatgtcggtagcgcatcaatcatcaaacccaataataaggaatggacttattctgttatttgatattgttttattctttgtcttattaaatacattaccttttgaacccgctgtaagtaaaggtttagccttattagtatttgttgcggttttatggcttacggaagctctacacgttacagtaacggctctacttgtgcctattctggcgattggtctagggttagtaaaatctaaagaagccttaagtgcttttgctgatccaactatcttccttttctttggtggttttgctttagctacagcattacacattcaacagcttgatcgcctgattgcaaataaaattatggcaatggcaaaagggaaattatccgttgcggtgatttacctattctctgttactgcatttctttcaatgtggatgagtaatacagcaaccgcagcaatgatgttaccgcttgcaatggggattttaagtaaattagataaagaaactcaccacaacacctatgtctttgtattattagggattgcttatagtgcaagtattggtggaatggggacgctggttggtagtccaccaaatgcgattgtggcatcacagctgaatttaacttttgcagattggttaaaatatggcttgccgattatgtttatcttgatgccattaatgatcgcaacgctatatgtagtatttaaaccgaaatttgatgttacttttgagcatagttttgaaaaaattgagttaaatcgcgagcgtattattaccctttctatctttggcgttatcgcaatttgttgggtatttggcgataaaattaacccactaatttctggcttattagggctacaaggtaaaattggtagtttcgacagtattgttgcgctttttgctgcagtcttaatttgtatcactagagttgcttcgtgggacgatattcagaaaaataccgaatggggcgtattaatgcttttcggtggcggtttaaccttaagctcagtgctaggtcaaacaggggctagtaaagtaatggcagatggtatcgtattcttaattgaagacggatacttctaccttatcggattactggttgcagcatttattattttcttaacagaatttacctctaatacagcaagtgctgcattattagtaccaatctttatttctattgctcaagccttaaatatgccgccagtagggcttgcattaattatcggcttaggtgcgtcttgtgcctttatgttaccagttgcaacaccgccaaatgcgattgtatttggtacagggcaaattaaacagagtgagatggtgaaagctggtttctggcttaacattatctgtatttttgtcattgcaacggcagggtatttgttctggttgtaatccgtatctttatgcaaaaagcggtcacttcgtggccgctttttgcatcttaaggaagataggatattggctcgatttgaatgtttttgagaagattgtgtcaaagaacataattactttattttatgaagaaattcataagatcaacgaataatttgatctacattacccaaaatataattgaaactgttataatcgccccgttttttatttttgaaaatcaaaagaggaactaactatgtccgtaaaaaaaatggcagatcttgacctagcaggcaaacgccttttcattcgtgcagaccttaacgtgcctgttaaagatggcaaagttacatcagacgttcgtatccgtgcaacaatcccaacattaaaattagccttacaaaaaggggctaaagtaatggtgacgtcgcacttaggtcgtccgactgaaggggtatttgaagaagcaaactctttacaacctgtggttgattatttaaatgcttcagatttaggtgttcctgttcgtttagtgcgtgattacttagatggcgttgatgtaaaagaaaacgaaatcgtggtgcttgaaaacgtgcgtattaacaaaggtgagaagaaaaacgatcctgagttagcgaaaaaatatgcggcactttgtgatgtatttgtaatggacgcattcggtaccgcgcatcgtgcagaaggttcaacttacggcgtggcagaatacgcaccagttgcttgtgcaggtccattacttgcagcagaattagatgctttaggtaaagcattaaaagagccacaacgcccaatgcttgcaattgtaggtggttcaaaagtatctactaaattaactgtattagacagtctttcaaaaatcgctgaccaattaatcgtaggtggcggtatcgcaaatacattcattgcggcagaaggtcacaatgtaggtaaatcattatacgaagcggatttaattcctgaagcacaactcttatctaaagcaacaaacattcctgtgccagttgatgtgcgtgttggtttagagttctctgacgctgctgcggcaacgcacaaagcagtaaacgaagtagctgcagaagaatcaatcttcgacattggcgataaatcagcggaagagttagcagaaattatccgtaatgcgaaaacaatcctttggaatggtccagttggtgtatttgagttccctaacttccgtaaaggtacagaagtggttgctcaagctatcgttgatgcgacagcaaatggtgcattctcaatcgcaggtggcggtgatactttagcagcaattgatatgtttggtatcgcagataaaatctcttacatttcaacaggtggtggtgcgttcttagagttcgtagaaggcaaaatcttaccagcggttgaaattttagagaaacgtgcgaatagctaattttattcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataaaaatcccaaactagaaggaaacaaaaaatggcaaaattattagacatcgtaaaaccaggtgttgtaacaggtgatgacgtacaaaaaatctttgcttatgcaaaagaacacaacttcgcacttcctgcggtaaactgcgtaggttcagactcagtaaacgcagtattagagactgcagcacgcgttaaagcaccagttatcgtgcaattctcaaatggcggtgctcaattctacgctggtaaaggtatcaaaccagcaagtggtgctcgtgcagatgtattaggtgcaatcgcaggtgcaaaacacgttcacgaattagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaagagtacggtgtaccagtgattcttcacacagaccatgctgcgaaaaaattacttccgtggattgacggtatgttagaagcaggtgaaaaatacttcgctgaaacaggtcgtccattattctcttcacatatgattgacctttcagaagagccaatcgaagaaaatatggaaatttgcaaaaaatacttagagcgtatgagcaaaatcggtatgacccttgaaatcgaaatcggtatcactggtggtgaagaagatggcgtagataacagcgatgttgatgagtcacgtttatatacacaaccagaagatgtgttattcgtttacgattcattaaacccagtaagcccacgtttcactgttgcagcagcgtttggtaacgtacacggtgtttacaaaccaggtaacgtaaaattaaaaccatctatcttaggtgcatcacaagagttcgtatctaaagagcgtggcttacctgcgaaatcaatcgacttcgtattccacggcggttcaggttcttcacaagaggagatccgtgaagcaattggctacggcgcaatcaaaatgaatatcgacacagatacacaatgggcatcttgggcgggtattttagattactacaatgcaaacaaagattacttgcaaggtcaattaggtaacccagaaggccctgattcaccaaacaaaaaatactacgatccacgcgtttggttacgcaaaatggaagagtctatgtctaaacgcttagagcaatctttcattgacttaaattgtgtagatgtattgtaatttttaaatatagcttttcgtttcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgaaggcggaagggggcaattaatttaaacgaaaattttgtaacatcgttgtaattccccccaccctaaccttaccccgtaaacggcggaagggattatttcttagcctttcaaaataactatggcacttccacttctcgatattcagtccgtcagtaaacgctttactgatcgcattggcattttccgtaagcaagatttttatgcggtaaaaaatgtttcctttagcttatatcaccaagaaacccttgcgattatcggggcgaacggagcggggaaatccaccttagccaaaatgctcgtaggtattactgaaccaacgtcgggcaaaatgtttttcaaagatcacgaattgacctacggtgactacgcttttcgagcgaagaagatcagaatgattttccaagatccaaatgatgcctttgatcccaattataatatcgggcagattttggattcgccactgaaacttgctacccatctttctgaagaaaaacgtaacgaacggatatttaaaaccttaaaattagttggtttgtatcctgaacacgccttgattcatataaaagaggcatcaagtagccaaaaacagcggattgcattagcaagagcgttgattctcaatcctgaaattatcatcattgacgacacactcagtgccttagacttttcggtgaaaacacaattaactaacctaatgttaaatttacaggaacgtttaggattatcctatatctatgttggacagaatctcggtatgattaagcatatcgcagataaattgatggtaatggatcaaggtgaagtggtcgaatatggcagtaccaaagaagtgctattgaaccctcaacacccaatcacaatacgtttaatcgaaagccattttggcaaacgcctcaccccagaggcttgggcaaattaaaaaggagatgttatgcaacttattgatgtcatcaaacaacgcaaaacaataaaaatgttcaataatcaagttcagattagccgtgaagaactcaccgaaatgatcgaacttgcccagcttgctccatcaaaagccaatcttcaaccgtggcggtttgtgatattggatcaggcagaacaaaaacagaaactgttggataaagtcgcctttaacgcaccgccttgtgaaagtgcttcagcggtagtcgtcattttggcggatcttcattatgaaaagttacttggcgatgtgttagatcattctattgcaagcggctgtttacaccaaaattttcgcgaaaattcctttaatttcttaatgggcgtacacaatacactcagcccacaggatattcgagatcaagtgttgattgatacgagtttagcggcaatgcagctaatgttagttgtcaaagagaaaggttacgatagccacgctattggtatttttgatcgtaaggcagtgttagaagtcctagaaattgacagcgaacgttatgccccagtgatgttattagcgattggcaaagcggctgtgccagccttaccaagcgtccgtttaccgacagaatatacggtttcgtggaatgatggaaaacaattccgtaaataatttaccctgattcaagcagtcagatttgttaattcttttacaaaaaattgttaaaatctcaccgcttttattttattgagaaacaactatgaatacattaaaaaacattcagttaaaacaaagtatttttagcaaaattatctttgcaagccgttggttacaacttcctatttatttaggtttaattgtggtacaagggatttatgcctataaattcttaaaatccttatggaatttagtggttaatctcggtgtgatggacgaaaacactattatgctagcagtgttaaatcttattgacgtggtaatgattgcaaacctattaattatggtgattgtcgggggatatgaaacctttgtatcacgcttaaatgttgataaccacccagaccagccggaatggctcgatcacgtgaatgcttctgtgctaaaagtgaagctctcaatggcgattatcagtatttcatctattcacttactgcaaacatttatcaacgctgcaaaattaagccctgaaacaatgatgtggcaattattaatccatatcggctttattttatcggcgattggcgtggcttatacggataaattattaaatagtgtcgcacacgcgaaacattagttagatgtttttaagtatacttgatataacttggctaggcatagtattgacagtattcctgaagtttgtctactatgctctatcctatctataccgatctaaaaaacgataataattcaccccaattttaagtgccatttgtttgacaagttttccgccaaataaacttggcactttcagggcttcaaaaatacgcaaacgctcgtcattgccctcaatggcttcggcgataatacgacctgcaagccctgttagtgcaacgccgtgacctgaaaagccgtgagcaaaataaacattagacttcactcgaccgaagtgaggtgaggcatttagagtcatatcaatcggcccaccccaaccataatcaattttgacatcttcaagttgagggaacacatcaagcatattacgacgcatttttgccatcatatcgacatttgaactggaatcgctaccaaagagtaagcggttatccgcactcaagcggtaataatcaagcaaaatattgttatcgcagacagacataccattattgataacactatccgccattgcttgagttaatggctcggtcgcaatgataaaactttccacaggaagaatttttcgagcaagtttgaaaccaatttttttattagatttagcgtcgatataagcatttgttgccaatatgacgttatctgcggtaatagtaccttgtggggtaataactttaacttgtttatctgaaaattgtagatcaagggctggagtgtgttcgtaaatgatgactccttgctctaaacaggctgccgctaaccctagacaataatttaatgggtgtaaatgtccagattgactatcgtataacgccccacaataaattttactgcctaaatgctgttctaactttgccctatcccatagttgcatatgttgatagccaaagcgttcacggctctctttttcaatcgcaatcaaatcgtccattcgacgatgatttaatgcaagtgttgcatagcctttcttccaatcacattgaatgttgtaggttttgacacgctcgtcaataatatcgagcgcttcaagggacatattccaaagtttacgagcattttcttcgccaacttgttcaatatactcatcaatcccttcttcaaaaccgtttattgcttgtccaccattacgtcccgatgcaccatacccaaccctagcaccttcaacaacaatcacattcttacccttttctgccagctccagtgcggtagaaagccctaaaaagcctgcaccaattacgcaaacgtccatagattgattgcttgaaagatgaggcaattgaaagtgaatattacgagtatcggaatagtatgtacgaatatgttcttgatgtgcaaaagtcagcataaaaaccgttttaatgatactaaatgaaattaggaagttagtttgaaatggcgcacccgagaggattcgaacctctgaccgctcggttcgtagccgagtactctatccagctgagctacgggtgcgtatttgaaaagaaacggtgttatttattttatcagcaaccattttatcctgatagataaaaataaaatggcgcacccgagaggattcgaacctctgaccgctcggttcgtagccgagtactctatccagctgagctacgggtgcgtgataaagtaaatggcggtgagagagggattcgaaccctcgatggagctttttaaccccatactcccttagcaggggagcgccttcagcctgctcggccatctcaccactcactgtgtctgtgggcgtgcatattactaggttctggaaatatgtcaaattatttttgcaaaaaaattaaaattacagaccgcttgcctagttactaatcaaaacgatgaatttatagcatttcttgaataaaggctaaacttttcatagggttagttttttttcataccaaattttattgatatagagcatcacttttccagcaggagtttcaacttgaatttcatcatcaatttgtttgccaattaatgctcttgcaacgggggaatcaatcgaaatccattgttttgctggatcaaattcatcacagcccacaatccgatactgctttatttcaccttcctcattttctagttcaacccaagcaccaaaaaagactttaccctcttgagaagggtggtaatcgacaatttgtagtacttccaaacgtttggataaaaaacgtacacggcgatcgatctcacgcaaacggcgtttaccataaatatattccgcattttcactgcgatcacctaatgctgcagcctcagatactgcctgtgttaccttgggtctttcctctttccaaagatatttcagctcttggtctaatgcttgccaaccagaacgagtaatataatttgactttgccattagcttgcgaactccacaatgcccgtaacttttcctgcttcattgaccgctattaatgagtgaatatgtttctctttcatatactcttctgcgtgagcaaggaaagtgctatctaaaatcgtttttggattacagctcataatcttttgagccgttttattcaggctttctgcaccaaatttagcaagtgtacgacgaatatcaccatcggtaataatgcccagcaattgctcattttccataacaatagctacccccattcgtccttcattcattacattcaagcaatcgctaaaactacaaagcggacagataataggcaattttttctgcataacatcacgcacacgacaaagcaattttctaccaaggctaccaccagggtggaaacgagcaaagtcttccgctttaaaatctcgagctttaatcagagcaatcgctaagacatcgcccaatgccatagtcactaaacttgaggtcgtcggggcaagattatttggacaggcctcacgctcaatactaatatcaagggttatatctgcgtgacgagccaatgttgattgcagatttcccgtcattgcaataatcttattcccaaaatttttcaaacttggaatcagtttatttacatcatcagtttcaccgctgtaagagattaaaatcactacatcaatcggtttcaacatacctaaatcgccgtgaaaggcttccgttgggtgtaaaaagaaacttggtgtgcctgttgaagcaaaggttgcaaccattttcttaccaactaatcctgacttaccaatacctgcaactacaactcgtccttcgcagtttaatatcatatcaacggcttgattaaaggcttcagataagtgttgattgaggcgagaaatagcttgtgtataaagatgtagagcttcatttgcaattggaagatggttcataacatatcctagctaaaataaaatattgagcgaattatacgctagtttaagaaaataagcctatctaatctccatgaaattatatagtcgttctgctcttgatttatctattttctcaagttgagatagtgctgttttttgcttctcaatatccttcttcatattggcacataaggcgatattttctagtgtatctgcttgattgtaataggcttcttgactggttaatgccgtttcaaattgctgataggctttgtcgaactgtttttgtttgcacagaaaggtaccgtagttattcaatacatcagggcgaacttgattgtttttgctctgtgttttacttaacttcaaggcttgctggtaggcttcttctgctttttggttatcgccagtttgttggtaataataggcaagcacagagtgcggtaggtagtcttttacatcgtgttcaagcgctttgtcaatgttttctttcgcttttggaaaatcagattgttcaaggtaagcaagggccaaattaatgcgagctttgacggcttccgagcggttaaaatccacctgagtagtttggttcgcacaagcaacaagccataatgccacgctacaagcggtcaaattacggaaaaattttgcaaaggtcatcatttaactcctcgatttaaagtaaattgtagggacgccacgcttggcgtcctttaagtattacttttatacaagtctagattaaacggacgccaagcgtggcgtccctacattctttcttatatctgtaacatcataaaatagaagagctttattgattttgaaccgcaatcccttcgccgaatttacgtttttcaaaggtgcgtttagtgcggtcaatcacatcacccgcaagttgcccacaggcagcatcaatatcatcaccacgagttttacgcactgtcaccgtaaagccatattccatcaaggttttttggaagcgatcaatacgcgtatttgaactcttcgcataaggtgcttctgggaacgggttccacgggattaagttgattttacttggggtatttttcaatacatctgccaactgatgagcgtgttccacatcatcattgacgtggcttagcatcacatattcaatcgtcactttaccgtgattagcgtttgatacttctaagtatttattcactgaatcaattaacattttaatgttgtattttttattcagtggaattaattcattacgcagttcatcgtttggtgcgtgcaatgaaatcgctaatgcaacatcaatctgctcacgcattttatctaacgctggtacaacccctgatgtagaaagggtcacacggcgtttagacagtccataagcaaaatcgtctaacataatttccattgccggaataacgttattcatatttagcaacggctcacccattcccatcatcaccacattggtaatcggacgaatgcccgttacaccaaagttaccgataatttttgaagctcgccacacctgcccgataatttcagatacgcttaaattacggttaaagccttgctgtgccgttgaacagaaagtacaagccaaggcacaacccacctgcgaagaaacacacaaggtggcacgatcatcttctgggatatataccgtttcaatttgctgatcgccaacccacatcgcccatttgattgtgccgtcggcagaacgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcaggcgctttaatctcagcgatccgttttaatttttcacgcaacaccttattgatgttggtcatattatcaaaattatcttcaccaaaatgataaatccatttcatcagctgatcagcacgaaatggcttctcgcccatttccgcaaatagttcacgcatctgctgacgatttaagtttaataagttaattttttcagttttggttgaattacaacttgcatcggttgcttgaatttgttcagacattgtttgaaagcctcgttgttacacggtttgtggcaaaaggttagttttgctggaatttagttaaattaaaggcggcaattctactgttgtctgctcatttaggctagtgatttttacaagatttgaaaagttgaaataatgaatttttcgacggggatcacaaaaatagttcggcttgcggtaaacaagccgatattcacttaaatgctcgcaatttgctcaaatgtttttggcgatttttcaaccatttttaatagtaagaccgcttgcggattgggctttgttcttccttgctcccaaccttgataagttctcaccgaagtgtgtaatttacgagcaaaaaccgcttgtgaaagatttaatttttggcgaatagctttcacttcttcgggggtaatcactatcggatcaggaacttccacaacagtggtttttagtgtaattttgccttgtaagtgtaactctaatgcttgcatcccttccattagttcattaaataattttcccatatattacctcactaaagattttaaatagcttaatgtattcgccaaaaccacaagttcttcattagataaatcgtcttgttggtttttattgtaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagattaccctagctccgcctctttttcctttttgtctaataatatccacaatacgcaattttcttagtcccccagtaccttgaataagctctcccttatcgggaaattttagtaactcattttgtaataatctaaatgagtcatcgtcaagatacttttttctatattcctcaaaaggcggcaactccacaaaagcgacattcattattctactcctatttttaagttaaatatacgtttaaaacgtatagttttagggaaaaacagaaaaagcctaattgaaatataaaaaagagaaaggacaagagataaatttttcgacagagatcgaaaaaatagtaaaaagtcaaagataagcggtcagatcaaacaaaaaatttgcaaaataagaaggagattgatgaaaagtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcgttgtgggttggcattatagagttcaaaaattttcagtcaatccatttttgctattttttggctattcgttgaaaaattcacctaaactgtcaacttttcactatgatttccgctcaagaggggtaaaataccgaaacctttttgtttagaaaattctgaaaaaatataggcgataatatgaaaattgaaacccttttccctttagatccaaatgtgaaggtgcgtactcgtttcgcaccaagtccgacaggctatttacacgttggtggagctagaacggcactttattcttggttatatgctaaacataacaacggcgaatttgtattacgcattgaagataccgaccttgagcgttctaccccagaagcaaccgcagcgattatcgaaggcatggaatggcttaacttagcgtgggaacacggtacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtttttagctgatcgataacaggcactttaaagtgtaaacctggtttataaacaatcactttattatcggcatcacggtgtactttgttaaaacgtaacataatgccacgctgaccttcttttactacgataaccgattggaaaaggataaatgtcacaacagctaaaacaggtaaaagtaacttacgcattcttaaaatctccctttacgcacaggctcattctgttccactgcaggtaattgagcagggctaacaggttgagcaagttgcggctgttgttgaataacaggttgtgatgatggtgtttttaccgcttcatttgtcgttgatttagccatcaatctatcaataggtaacaccgttagattattgccgtttgagctatctaccattaacttcggtgtatttttcatcactttttccattgtttgaatatacaagcggtcacgagtgacttctggtgcggctttatattcaggcaataattgagtaaagcgttgtacttcacctcgagcatttaacacaacttgctctttgtaggcatttgcttgctctaaaatacgttgtgcttgaccacgagcaattggctcttgccctcttgcgtaggcttcggcttcacgaattaaacgctgctcatcttcttgtgctttgatggcatcatcaaatgccgctttcacttcttcaggcggacgagcatattggaagttcacatcggtgatcaataatcccatatcataatttttgataatatcacgcaaggcattccacgttttttcacgcacaatcgcacgccctgtggttaaaatatcgtccattgtcatatgtccgatcacataacgcaatgcactgtcagtcgcttgtttcaagctatcatcaggtttggtcacgctaaagagatatttcgctggatcttcaatacggtattgaacggtcatttctaccaacaccatattttcatcttgggtaagcatagagccgttagttctcagttctaacacacgttcaatattcactggcgttacattatcaataaaagttggtttccagtttagaccaggtaaaacaatttcgtgtaatttaccgaaacgagtaactacgccacgttctgcctcttggacggtataaaaccctgaagctccccatacaactaagcctaagccgagtaatacaggtaaaaattttcctgcagaaacagctggacggttattttggtttgaaccattgcctttaccgccacccatttttctcaataagctattaaaaacttcctctaaatcaggtggttgctgttcatttgattgcttattcggctctttttcttgacccgatggttgtttttgttcaggctttttttgccctggtttaccccaaggatcttgctgattgcctgattcgttccacgacataacgttctccaaagttaaatttttcttcgcaaatgttaataaaatgcaagcgtttgattgtacctatttacaaaacttttggctagattgaatgtgtaaattattttatcgccacttagcaatatataacgtacaataaaaaatatcggatatatgtttgctcctattcaatataatgaaaaaacatgactaaaatcagcctagtttaaatatgtgaaagataattaatgaataagagaggaaaaatgtataagcacctttggctttctaatttttttggtcgaaatatcgctgatctggatcttattagtaaagggagcaactcggatttagttctcgctgatttctctctcattcaaacaaaattgccaagctgggcaataacggaaatagcttgggtgcagcagcaagattttcagtttgtagaaggtgagattgtttttgaatatgatcttgcacatttttcacctgaactgaccgcttgtcgtgtggcaacggaacaggatttggttcaacttgaacccttttcgcatttgttttcacaaacgcgttttcgttcgccttggttttcattgttagaaaatcgtcgattttattggcaatggattaaaaatgcagttaagggagaatttgacgatatttgtttactcagtgaagccacaagcggtgaaatacaagggatgattacccttcgagtaaaagagactacggcacatattggcttgttggcggtcgcagaaaaatggcggaagcagggggttagctatcgcttattaatgaatgcgatcgcttgggcgaaacgtcagcaagcgacgaaaatggtgattaccacccagctgagcaatttagctgcaattctgctttatcaacgcttaaacggaaaaatcagcggcacttattattggttttatcgatgatgcaaaacattccttttaaccgaccgcctgtattaggtacagagctaaattatgtccagcaagcgatctgttcagataagctatctggagatggtcactttacccgtctatgtgagcaatggcttgaacaacggtttcacgcacataaagtgttactgacaccttcttgtacggcggcgctagaaatggcagcgattttacttgatattcaatcgggtgatgaagtgattatgccaagctatacctttgtttctacggcaaatgcctttgcactgcgtggggcgaaaatcgtgtttgtagatgttcgaccggatacgatgaatatcgatgaagccttgatagaacaagcgattacccccaaaacgaaggtaattgtccctgtacattatgcgggtgtggcgtgtgaaatggatagcattatggcattggcacagaaatatcgcttatgggtggtagaagatgcggctcaagggattaatgcattttataaagggaaagcacttggcacgattgggcatattggctgttacagtttccacgaaacgaaaaatatcaccgcagggggagaaggcggggcgattgtcattaatcagcctgaactgaccgctcgtgctgaaattattcgagaaaaaggcacagatcgtcagcaattttttcgtggcgaagtagataagtatagttggcgagatctcggctcaagttttttaatgtcagaaatacaagcggcttacctttatgctcagttacaagggttagaacaaatccaacaaaaacggcagatgatttggcaatgttattttgacgcattacagcctttggcagagaaagggattgtggaattgccctacattccccaagagtgccaagcaaatgcccatctgttttatataaaatggcaaaatctcaaggtgcgaacggattttattaatgcaatgaaatcaaaaggaattttgacggtcttccattatgtgccattatattcaagccctgcagggcagcagtttggccgattttgtggagaagacaaatggacgactaaagagagcgagcggttagtgagattgccactgttttttaatatgcaaaatgaaagtattgaacatgtaattagggcaatattgttttggaaagcctgatatattctcttaaaggaatgtctcaggatttgagctagggtgaagactttttctttataccatcgcaattaggttatatagaaaattctgcaaaatcacaccgcttatatttgtcgatattctacacctgccacgaaataaacgcccaacgggcttgatcgtggctgattttttgttgagattgctgtttttgctgatagaaggcctgtaatttttgtcgttctagttcggttaatgtccctagcgaaaactccacggcattttgcagatcttggtatgtttccccttgaaagccccctgtttctccctgtaaaaagtcagttctgcctgaataccacgctgataaagacggtttaacagatagatataaaaggcgtaaacttgtttgcataaacgggctaggggaatggcaagcgttcccggtcctgagccaatatccaatacactatctgtcggttcaatcttcattttatctagaaattgacgggtataactgttctctttttcaacaaaagtttcggcaaatctaaccgctttcttatcccatttctcagcggtaacatcatgataacgatatgcaatcagatgttgtttataaagttgagcaaaatcaatgtcgtagaatgaattcatgttattccttaaaaggtaaatgttgagccaaacttgtcatatcaatacgataggttttggctagttgatgaagagtgagcatatcggcttttttcccttgttgaaaggctggctgatgttgcttatctaaaatcacaacgctatctgcaaggtaatcggcgtgctgtaaagggaaataaactttgatgcgcttgcggcacataggcaatttgttgggctaactgttgtggtgaataggtaacaagcggttggtttgcaaagaaaatttccccgtgcaattttgcttgagtacccaataacgtgcgtaaaaaggtactttccctgccccatttgcccctaacacacagcagatgtcatttgttcccagacgaaaatcgatccctgagatcaaaggctgactggcatagccaatcgttaggtttttcgtttccagtatcacagttaccaacaataccgcactaataccgccgacaaatgcaaaaagttgcacataccacatcggcaaattgcaaaaaatcgccaacgaagcccccaaaccagcccctaccgatacacctaaaatatcgggagaaaccaacgggtttttaaacatcccctgatagattgcccctgcacaagctagtgcagccccgactaagcaagcaacaataatccgtggtactcgaatatgccataacaccgtttgaatttggttggtttcgcattcaacagagaaagcacaaacgaccgcttgccacactgctgttggcgaaatcggatactttccgagattaagcgaaaacaaaatagccagtaataagagcaaactcaatatcagtaaattgcgtaaaaatgatgtcagggttccattgcaaaagctgttccatttaattttttgtacatgctcagctttgggtaaattgccaaaatgggtactgatcggctgctcattggcagacacaccacttgtcacaaacgccaataaagcgaatgcagaaagaaattttttcataatctagcttctgtgattaagacaaaatcattatatttaaaattatataacgatagaaattgatcaacaagtcaatacattatgtaaatttttgcaaaaaatgaatgatcgttcagtttagagctagtcgaaatggggcgttttctttaaaatacgccccatcattttttaatcaaggaatttctaatgaaagtgtcaaaacttacttttacattactttctgcactggtactttcagcttgtaccaatatgagcaacgatggctctctacaaaaagcacagcaagattataaacaatatcaagatattaccaaacaatatcaaatcaatgagcaatggtggttaggctataatgatactcagcttaaccgcttagttgaaacggcacttggcaataatatcaatttggcaaaaacagctatttctgtgaataaagccttatataacgcaaacttagtgggtgcaaatttagtcccaactttcactgcttcggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcttctgcttcaaaaggtgttggttctagcagtaacctaaactcgactggcacatcaagtattggacatcaaattagcttaaacctaagttatacccttgatttatgggggcgtttaagagataccgcaagtgcggcagagtgggaacacaaagctacccaaaaagatttacaagcggcgagattatctttaattaatgccgttgtgagtagctattacaatcttgcctattatcaagacgcaatccgcattactcaacaaagcataaaaagctatgagcagatcaaccgcattttaagcaataaattcaaacagggattaatcgaccagcttagcgtagatcaatcaatgcaagcggtgctttctgcacaaaataccttaatcaacttacaatcggctcaaaaatccagtgagcaagttttgcgtaatttgctaaatttaaaaccgaacgaaccgcttgtagtcaattatccgagtattcttaaggtcaaattacaagatgttgatgtgaatgttcctgtttcaaccattgctaatcgcccagatgtactggcaagcttacagcgtttacaaggggcatttaaaaaccttactgcaactgaaaatagctggttcccaacggtcacgttagggggaagcctaacaggaagttcgacgaagtttaacaatacgtcagataaccctgtcgctggtggcgtggtgtcttttgatttgccgttcttagattggaacagagtacaaaataacattaagatttcagaagagggttataagctggctaaattgaactatgaacagacagtaacaaccgcattaaatgaaatcgacacctactattccacttaccaactgtcaaaaagtggctatgcgaatttacagaaaaaatatgagtacgatagaaaaatcagcggatattataaaaaccgctacgatcaaggtatctctgaattgcgtgaatggctaagtgcaatgaacaccgaacgtagctcagagctttcgttgcttgaaaataaatataccctgctcaaaaatgagaatgccatttatcaggcaatggctgggaaatatcgcaaatagtatatttaagtataatagcagtgagaaattaagctgcgcctctaatttctcaccttttactacattctagcctttaaatcgggaaacccacccaaatccttcaacttattcaccattgcacaaaacagctctgcagtgcgttccgtatcgtacaaggcagaatgggcttgtttgccgtcaaaaggaatttgtgccatttggcaagctttgactaagaccgtttgtccatacataaaaccagccaaggttgcagtatcaaacattgcaaaagggtggaacggatctcgtttggtattaatgcgttttaccgccgcttgtaaaaatgcctgatcaaaagtcgcattatgtgccacaatcacagcacgttggcagccgttgtcttttaccgctttgcgtaccattttaaacatctcggtaatggcaatatcttctggcacagcaccacgctcggcgttagatcggaagagctcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctggcacagcaccacgctcggcgttatctacatcaattccatttacttttaatgcctctggattgatattggcattttcaaaaggtttaacgtggcgatgaaatttttcatctaaatgcaaatagccgtcgtcgtccattttcagcgtaatcgccgcaatttctaacaatgcgtccgtttgagcatttaatccccccgtttcgacatcaaccacaacaggaagatagccacgaaagcgatttttcaatagattgtaattggttgcttctgtttcagccattaacctaacgccttttgtgcatctttgttagcgataaattcgattttgtaaccatcaggatcttctacgaacgcaatcacagttttgccacctaacacaggaccagcctcacgagtgacctttccacctgcttgacgaaccgcttcaaccgttgcgtaaatatcatccaccccaatcgcaatatgaccataagcagtacctaactcatagctctcaactccccagttataagtcagctcaagcacggcactttcactttcatctgcataacctaaaaatgcaagggtatatttatattgctcattttcgctggtgcgtaataaacgcataccaagcacttctgtgtaaaatttgatagaacgttctaggtttcctactcgcaacattgtatgtaaaattcgcatcgtaaaatcctcttaaaaatagaaaaaagtggcgatattatggcataatctcgccctaaaatcatttttgaattgaaactatggctcacgatcacgatacaccttctaaattagaaatcgccacgcacgctattttgcctttagtgacgatgttattgattgaaatgtcactcaatcactattttgcaccgcaaaatgcaatctttgtttcgccttatctgctcaccttttttactgtttgcttgattagcttcgtggtgctgtggaaagggcaaatttgcccagggcaaaaagggcgtttaacggctattctgccgtggctcttggtctttgcggtaggaaattttctctattcccttgcttttaccccgaaacattcccctgctttagtcgctggatttgcttctgttattctgccgtttatctattggaaattgcccaaagatgaagatatttatcgcacggtgatttattgtggcttaggcatcaccgccattggtatggtgcaatatttgctgatttattggtatgaagtaccgtcgctgtttaactggattagagccaataattttgcccagattttactcggtattttattaagcggttggtatttaatgctagcgaaaagccgtttggaaggctttttaaaactgttggtattgttagcacttatggtattaatcatcaactatgtttgggtgattttcgtgttatatcaacaacttgcgattatgcctgagatggtgatttatccttactttatcttctttggggttcagtttgtgattttgatgatgttagcttggttgctactcggtaaacagggaaaaaacatcaaaaatccaaccgcttggacggtcgctaccttccttgcaatgctttatcctttgacaaatattctctaaatgttacgcagaagtttattgattatcggtgcagtacttgccattttaatggctggtggtgcatcattgctttcaggctctcaattagcttctgcgattaatttgtcattgccaacgggctggaaaatagaaacacccgatggtattgagccacatttagaaaaagcaatcctgccacaatttactatttactatcaacattgtccgattatttcggcagagagcctttcggtgcaatggcttgatgaacaatctattcgtcttaatcaagcgactgttgattacgcctgcgtatctctttttcctaaatcggaaaaaagccaaaccgatcccacagaaaccattaaaacgatccttgcgttactgccagaaggtaacatagaaatcaaatctttggcgtggaaaaatcttcccaacgaaatgcatgaacgtttgaagggattactgcaatcaccaagtgaaattaaatttgcattttttcagcaaaaactgaccgcttacattaagcaacaagcggtcacatttgacgcaaattttgcaaatcagcaactcaccacacaacttagctatcaaccaaataatgatgagcaacatcacgtaacactttctgctcagttagatgaacattttctagcattgccccagcaacttagcttgaattatcagtggcatttgcctgaagccttgattgcggaaccaagtttgcaacaaggacattcaacgctcaactggtataaacaagatcaacaacttcacggaaattggcagttaaattccgccataacacctgaaaatcagttcaacttgccgtttcattttgatacgcaaagcctgacgattgaaaaagggaaaattgattggcaactctcaaatgattttccgctcaatgcgtatctaaccaccaccattacccctaaccgtttttccttagatgagctttatccgataaaaacggcggtgcgtatcagcttacttactcaaaatgccaaagggaaaggcaatgttgtgatcagtagtccacaaggggaaattcagcaagacagtttgattttgccactacaaattacaggtaatatcaaacaaggtgagcatattttatatagcactattcctttagatgtaaggggaaaatttgatgatctcaccttacgctttttgcaaggtgctttgttacgtctaactgggactgaacgctttcttaccatcaacgatttgcgttttccccttgctggcgtacgggtagataagcagggcattcacggtcgattgcaagcgattttccgtggagaaagccctgactttaaaaatattgaaatgcggttggacggttatgccaacaatttcaaagcgggagcattacactttttccaagatccaaccgataaaaaagcggtgaaagatcaatggaattggcgtttttggggcagttcgcaaataaaagccttaaaccgaccgcttgcggtgtctgggcgtggtgtgtggcataaagatttagtgcaactatctgaatttaaaggcagtctggaacagattggtaaaaatggggtatccattcccaaaacagagctggttttgaatgagccgattaactttgattacgataaatttcatctcactgggggaataaaactcttttctccgcagattaattttgcctatggtggcactttagaaaagccaacggcacacttaaatttttacggcgaagtggaaaatcttaactttaggggtgatgttaccgccaatcaattaggaccgattaaactctttgctcgccgaaaattaaccaataatgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcggtaagctatattggtcagagcaacctgcaaatgtattccaaagcctttttccttttagaaaccaatgggtcatcacaaacggtaccatcaaaggtgaaacgtcatttagtgcgaatgcagctcgtgggttgatggctggcgggcattttgctattcgcaacggtgcagtttcgctaccaaacggtgagatcaagggcattgatttctcactcccttatcaatacaaacagggtgaagtggatatcggcgtgaaaaaagcccttgatgtgaatattgatgaagtgaatatgggtattccgataaccaatgtcaaagtaaaaattcaaggacacttaccttacactaaacgtaagcctctgtttttacgagagttaagtttaaatttgcttgatgggcgtttaaatatcgaacattttgccctgccacaaacgaaaatcgcttatttaaagctgtttgatattcgttttgaacgcattttagaattggcacagtatcaccaactggatttaactggcaaattcaacggtatctttccgttttggctgtcgggtaaaccttgctacatctgcaatggcacattgacacaagcggatagatcttacctaaaatttacccctgaattgcttgaagcgattaaacaagggggctatacggaacagattttggcttatatggtcaataaaagtgagattgacgatttcaccgcaacggtgaatttagacagtaaaggcgatatggatttatcagctaaaatccattctagattgactgagcataaacaagcgaaagtcaatttgaattataaccataaagagaatatgttcgacctgtggaaattgattaactacggttctcagtttgagcagaatattgagcactcaatctataaacaattagataaacaataaccgcactcagtacatgctaagggctcagaattatctaagccacttatttactagaaacttttctcaaaactcaaataaactcgatttcgtttatacgaataaagatccactaaatttgagttcactcgctgatattgatagctgattttcggtgtaattccccaaaaatgcaggttacgatgccaaagtgtaacattcaaacctaactctctatctttgcgtatctgattaaaaatgcggtgagcttggtcaaattcacgtttgccataactgagctgaatacggctggaaattccgccccaccattcttgcccccaaccaattcgccctgtataacgttttgaggctaaagaacgttctaacgtccgatctcgcaacaaatctacaccaccatagagataacttttcgcatcaaaggcatagagtagcgtagcagaaccaaataatgttgtgctatctgcaagctgattttcgccccgatgtttgagcttgcccatttcgccagccgtagaaagctgccattgtgatgtaagccaatgctctacttctccccgaacgccatagccgtgattatagcgatgattaccataccaacgcatttcataataaggcaaaaaagcaagacgactttgagcattttgatattgatagccaagacttgaacggttttgctgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcgagtagcaacgcctgattccatcgctgcttttgcaactgctggggcaatgcgtacaattaaacgagggtcaaatggacgtgggataatataatccgcaccaaaggttgtcccctcgccaccataggcagaagtgaccacctcattttgctctgcaagagctaaatctgcaatcgcataaaccgccgcacgcttcatttcctcattgattgttgttgcgcctacatctaatgcaccacggaaaatgaatgggaagcaaagtacattattcacttggtttggatagtctgagcgtcctgtacagacaatcgcatctggacgagcagctttcgcttctggcggtgtaatttctggatttgggttagctaatgctaagataatcgggtgagccgccattgttctaaccatatcctgcgttaaagcacccgccgcagaacagcctaagaaaatatctgcatttggcatcgcatcacctaatgtccgccagccattatcatcaatcgcataatgtttcttggtgtcgtccatacgatcgtcacgatctttatagatcaccccttttgagtcgcagacaacgatattttcacgcttcatacctaaggatacaagcaagttcaagcaagcaatagaagccgcccctgcacctgatgcaactaaacgcacctcttcaatttttttatccacaatacgcaacgcattaatcaccgcagcagcactgatgattgcagtaccgtgctgatcatcgtggaatacaggaatgttcaatcgttcacgcaatttttgttcgatataaaaacattctggtgctttaatatcttcaagattgataccaccaaaggtaggttcaagagaagcgataatttcaactaatttttcaggatctttctcattaatttcgatgtcaaatacatcaattcctgcaaatttcttaaacagaacgcccttcccttccatcacaggcttacctgctaatgcaccgatattgcctaaacctaacacggcagttccgtttgaaatcacggcaactaagttaccttttgaagtataacgataggcagccgctgggtctttttcaatttctaaacacggctcagcaacccctggcgaataagctaatgcaagatcacgttgcgttgcgagggatttagtcggggtaacttcaattttaccagggataggaaattcgtggaaatcaagtgctgcttggcgtaattgagatttgtcatccatagttgtgtcctttatacaattgaataaatgaaatcatcggtattctacctaaattttgggaggaatattgtgatatagctctaattttttaacaaataattaaaaagtatagaaaggaataatctctaattaaatgagacgtttaatcatgatgccaaaattaagtattatttgaaataagtattatagagcgatactatgatcagtaattgaaagaaaatcaagaagttaattgagggcagagctgttttatacaacaagctctgcaaaataatgtgattgttagacgctatagagaatatttttttgcagtatctttcaacaaggtctgcaattcacctttttggaacatttcgagaacaatatcacaaccaccaattaattctccatctacccataattgaggaaatgttggccaatttgcgtattttggtaattcagctcgaatatctggattcgataaaacatcaacatacccaaatggaacttggcaatttacaatagcttctgaagcacgagcagaaaagccacaggatgggaatttaggagagcctttcatataaagaagaataggattctcgctgatttgtttttggattttttctatagtttccatgtttttcctcattgatcaataagaatatgtaccctattctaatgtgaaacagaattttctgcaatttgccattaacatcttctaaagtatttctgtggattatagtccacttattccaaatcatttcattaaaatatctgccaatatttgttcttttaatccactttgtcgttgaatttctgcttttactgcttgtttccaaattttttcttcactaaacaaggtaaactgttttttagcacgggtaatcgccgtataaatcagttcttttgttaatactggcgaatgagaaagtggcattaccaataaagtatgatcaaattcagaaccttgtgatttatgcacggtcattacataggcgggttcataacttggcaaacgactaagggaaatgtctaaatgttttccattttgttctgtttcaaaatatactctcaatcttcctgcttcatctggaagaattaagccaatatcaccactaaagatatgaagttgaggggcattttcggtaatcaaaattggcttgccaatgtagctgtctcggctatgtttaaaatgtaataaacgtgcttgtaataaggcttctgcaatggtttgatttaatcgttctacgcccaattcactgacgcgtaaggctgacaaaaagcgtacttgttggaatgctttaaatatctcaccgatagacacggcttctggggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcgagctttcactttgttcaagtaatcggaatataactccaccgctttttctaccacgctatttacacagtgttgtatccattgtgatttttcaggaaaatccgtgactttagggtaacacgctaatgttaaatcatcataagctctattcgttaaaatctgccacgatttcaccgcttgttgggtgttcacttgtttagctaactgcccaatccctgaattttcgtcaaaacgaaaacttcgacgaagatgacataatgaattacaaattgcggggacattttccactgtaggataaatttgatgttctgttacctcagttagatagtcactatgctcattgctataaccaaatctgatcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttctacagaagcaagttgatctttatccccaagcataatcaaacgagtatctggttttaaggcattcagcagtttttccagtatgaagagatcgatcattgacgcttcgtccacgactaacaaatctaaatgcagtggattttgagcgtgatgacgaggcagatcactatggggattaataccgattaacgaatggattgttgaggctctggttggtacttctgctttcaaactgtcaggaatatcaaggctagcgagattatttgaaatagcttcttttaaacgagccgcagcttttcctgtcggagcagcaagagcaatctttaaaagtggttggctctgttctaattgtttaagctgtaatgctgcaagtaaaatagcaactgttcgggttttgcctgtgccaggcccgcctgaaatcagacagaatcgtttagttaatgccgttgcaaccgcaattttttgccaatccgtatcagcttgttttggaaaaaagcgttgtaaaatttgacgatgaagatcgatatctgctttttttaaatccgaacttaccgcttgttgtaaataacgtgctacacgatactctgcctgccaataacgataaaaatatagacgatcctgttgaaataataaaggtgcaacctgtgtaggatcttggctaaaagcaacatggttatgtagcaacgactgccactctagcggtgaaatcccctcaattttttgcaaaatctccgtatgaaaatcacggctgaaatgctttttttgcaagtcaaaaaagtgggttgttaaatcagaatttaaacgaacacaactatgtccttgcataacattaaaagaaactaatgcacttagaaagattgctacattctgttgttgaaccgtatagttataagcctgctgtttctgatcgatcatttttgcaaattgatagtttaattcagaaatcacattctccgtttttaaggcataaagtagaggtaacataagcaaaaatttgataggaattgatggaagcagtatataaaaaaatccacgcatttgcgtggattttttaagataatatttgttaaaaatcagaactgataagacgcgttcaatttaatattgcgcccagccccttccattaagctaaatgcaggttggaactttttgtcaaagacattctcgatcatcatatctaaacgtaaattacgccattcgccagaaggggtgtaacttgcttttaaatctgtgagagtataacttggataagtcattgcgtgtgttttaggcactcgtttctgacttgcatagtgagtgatattcgctccaaccataaatgtttgaggcactatcgcgtaatcaatagtaaagcctaatttattcgctggaatattggataaggcttcctgtgtctggcgatttttgccttttgtttgagcataattcaatcccaatgctaaacgttcttgctggtaagcaaattctagctcaaatcctgttaagcgagcattttctacatttcgatactgtgagagagatggaatcatctctattggtgaagcacggaaaatatcaagatgaataaaatctttgacatcattttggaaataagtggcattgaagatgaatttatcttgatgtacaaagagattgtcaaaatgaactttcgccgcaatttctttatttttcgcggtttctgggcgtaagtttggattacttacaaaggtattattaaatgatcgtcccattaaatttgtgccaaagtgagacccgctgacaaagcgttcttgcattgatggtgtacggaatgctttattataacgagtactaagatctagccaatttgttgctttccaagttgcagcgatggatggagaccaacggcttgcactatatttggcttcgtcactttgtgttttaaagtgatcgtagcgaacacttggcgagacaataatgcgttcattccataatggaatatgtgttaaaagataaaatgcactgtttttagatttagcgtcataattattagggcggaatggtgttgtggcatttttctcacgctgtgttactactcggtctgaaataaaatctacaccatagtttagggctaaccaatttagatccgtcgaatttcgtatgtttaaacccatagtgctgagtttagtttgatcttgcaaaccgcttgcaatacgctgctctttttcttttgtactgttacggtatagcgtcaattgactattgatataatcattgtctttagggttaaagtaatagtgtaaggcactactttggtctgtgattttttgtttagctcgataacttacacttcctagtactgatgtgagtcctttatagaaacgagtcatttcagcaaaagaagctgttggattatttctatgccagtttctaataaggtttctcacatcttggttggtaaattcttcagcaacttcattgttggttggggcaatttgttcaaaatgacttaaacgatgagaaagctcaaggcgattttcatcattaatttgccaaccaaatttaaaaagtccgcctttttgagtatagcgactgtctactaattttttactgtccgctaaacgtaaatcatcagcgtggttataaaagccactcactaatccatcaaacttgtcatttgcggcaaagacactgacatctgtttcagagagagaattggcagattggtatccttgatgaatttttgctccaatttgctgattatctttcaataaatcaagtgcatttggtgttctgatcgcaacaattccccctaatgcaccgctgccccataaagtacttgtagggcctttgatcacttctatttcttgggttagtgccataggtaaaaaatatgaaccacggtgagataagtcaaaattctggcgaacgccatcaatcacttgaacaacacgattaccacttaagccccgaataatcggcttttgtgcaattccccttgatccgccagcaatatccacgtttgtaatccttttaatcgcatccgctgtacttatgggttgttgagttaataattggtttttatttagggttgctttctcacttgtgtgatttgcccagtgaaatgcatccctacttgcaatcacagagatttcagcgagttcagctgaaacattgctatctgcaagggatacggtaggcaaagagagaaagagtgctgtataaatttttgatagtctcattttagttgctcctttagtctgactaataaatatcctacaaaagataatgtaaattatcaataatgatattgataattcttatcatttagttaaaaatgaatagaaaaagcgttctaatacattattaataaaggagacctatcaaaatgaaacatttccatagaaaaaatgtaattactggaatcattatttcatgtgtatctggctttacttatgcaaatccaataccagattcaggaacattgaacaaacagttggaacagacacgccagatacaagtagcaaaagtaaaaccatctggagaactgttcaaaacaccaacacaggaagagaatcttcccgccaacaaagaaagtcttaaattccgtttagattcaatcaaattactggagttggacggaaacgaaattcaagataatctgacatctattacctctccttatcttcatcaagaaatcaccttagatgacttaaatcggttatcgcaacaaattactaactactatcgtgacaacaattatcttgttgctaaagcctttattccaccacaagaaattaataatggtgaattgcaaattttcgtgataaagggatcgcttgatcaggtagttgttagaaatggaagccgtttaaaagaagacttggttatgcggatggtgaatactactgtgaaaagccattcgtatttggttaaaaatgaactagaaaagttagctctattacttaatgacattaaaggaattacctcagcgttatctttgaaagcaggaaaaaatacaggtaaaacagatcttactgttaatcttaaagataataaacgttgggggggatatatttccattgataatcaaggaaatgataatactggaaaatatagaacaacattgggaaataaaatttataacttagttgggcttggtgatgaattacattttgatgtgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaaactatttaaaatataaattaggtgcgaattttaaagatcttaatgctcaagggagtacttataatttaggtggttatattactcaccctactattagaactgcaagtttaagattagatagtaaattagcatttaatcatcagaaattgtcagatgaacaaaaatctgttgatttacaacaaaaacggaaagtaaatacgactagcataggactgggtggttcttggaatagtataaaagaaggcgttacctatttttctttcaatactatttttgggaaagaaagccattcaacgaatgagaaaaaacactatttatcagagaattaccaacctaaacgtacatttacgacatttaattattcactatatcacgaacaatttttacctaaatccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttggctgttagtgggcaatttgctgataaaaatctagatagtggcaataaattcctactaggtggattatcgggggtaaaaggatatcaagcaggcactgtttctgtagatgaaggacatatcatccaagcagaactaaaacactacttacctgttttttcacaaagtatgctagtaagctcactcttttatgatgagggttttggaaaacaatataaaaatactgagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtgttggtttgaatttaattgaacctaatcattattctattaattttgcttatgcaaaacctatcggtaagaaatataacaatgtagataaaaatcaattttggttatctgcaattaaaacattttaattaaggagtacataaatgcgtaaacaaactttactttccgtagctatttcaacagcacttagcacaacaaatctttatgctgcagacttacctcaaaaccataaaattacagacggcaatgcaaaaattaataccttaaataaggcaatgaccattactcaagaatcacctagagtgagtattgagtgggaaagttttgatattggaaaacaaaatagtgttgaatttaaacagcctgattcaaccgctattgcttataatcgtgttatgggcggaaatgcaagtcaaatacaaggtaaattgcaagcaaatgggcgagtgtttctcgctaaccctaacggagttattataaccaaaggtgctgaaatcaatgtgggtagcttacttgcaacaactaaagatcttgaaaaaattagtaatagtaataatttcaattttactccacgtaaaaatcataaaactgctgaaggaaaaattattaatgagggtaaaattgttgcaaatggcgaaaatgcatttgttgttttagttggaaatgatgttgaaaataaggggacaattgaagctaaatactttaaacaagagaaaaaagttaaaggtcgttattgtagtggttggagtgcaaatgattgttatgagggtaatcattggggatttaagtggattgattttgaacgtgatgaaactattgaaagccctggacaagttgtcttgggcgctggcggaaaatttagcttagaattagatacgacatctattgatttagatattgaagaaaatacagtaaatagtattgtgaaaaattcaggttctattattaccgaagatggttatattgagctaactgctaagggaaaaagtgagttaattaataaccttgttaataatgatggattattacaggcggataatgttgtaatgtctcgatctggaaaaataactttattttctgatgatattaaatttggaaaaaatagtgatattcaagccgaaaatttaacaataaaagcgaaaaagaatgaaattaacttaaatgctgaaaaaggtgcaaaacttacaattaaagatagtattgattttgcagtcagtagctatctagacccagctataaagaaagttaatcttagtggtgatttaagtcgggaagataaaaactattatgatgacggctctaaaaaactaaaaacaaaagttaatctaaagctggcagataatctcgatgttggtaataaaaaagtaggtgaaaattcttttatcagcagtaattttttaggttctttactgggtatttcaggagaagtaaatctaaatgcacataattttgatatttcaggtgatataaatatagactcatataaagatactgattcagttttattattaaatacacaattaaattatactaatcctagctatattcgttttaataaagcaaatatagatactaaaaatgggcgtttatttattgcaacagatctaatggataaacattttgcggataaaggcatttcagatattaagattatagatagtaaatttaattttaataatggtgctattgttttaggtagaaatggtttaagaagaaatttagaagattctagaacttgtattaatcttgcctattgtttagaagatactcaaagatcgccttttagcgtaaatattagtaatttgcaacttgataaagtagatgattttgtcattgttggtggctttaataatgttgatattgatcgtcttactcatataggaagaggtaatttctatatttatgggggatattcctataataaagaaaaaccaagctatgactatgcgattttcaataccaaagatagagcgttgcgtacagaacgaaatcatactcaaagacgatggaaattcaataataatttacgtcaatggattaataatgagttcctatatgcatttgattggtggacagctacaaataatagttatgacaaaattaaacaagaagttattaaaacacctaaaagccatttagaaacgacaattaatattcgtaatagtaatataaaaacgcatgatggttttattaatcttatggcaaaaaatattaatttaaccgatagtcaatttaatgttacgtttgaccgaaatatgtcttttgaatctgattacgatcgtatccataaaattgggttaagtgcagataaaacgattttagatcacacgtcattaaatattcagggggctgaaaaactgaatgtttcaccaagttcaaaaatgaaagcggcaacaatgtatgtcgttggtgatttagaagggcgaaataaaagttcaattaacctgaaaagccatcaaggttatacgttgatgacagataaaaatgcaacattacgcggtgaaaaatcaaaaaatgatttaactattaccttgttaaatactggtcctaaaccttcacctgaaattggtattacaggttctgcggataatgatgcaaatgcagctaactttgctttagcccttggcgatgctacaaagactacgattgagaatgccacggttattgcactagctccaaatggtgctaaagcctattacagccataaagatatgcctatcgtgttgaaaaatactgattttacattttatgagcaaccgagaggaacaaactacggtgatgatgagctagccggagaaggaaatatcaaaagacttaatgagcgtcaattaaatacgatattagataaacttaacgggattaagccaacttatctatctcgcgaacagagtaatttagttgaaaataataagttcggagttaaatctctacaacctgaaacactagaagatgagaagagcgttgttgtctctatttgtgatgaaaacaataaatgtgaagatcgaattattggcaataaacataccgatgctaaagtttcggtaggtgaaattcgttagactaaatcgagaagacacaggtattggtttgttgaatacataaaaaaatccacgcatttgcgtggattttttgctaatgagtagaattattctacacgaagaatacgacaagtatttgtaccaccttcttttaactcatcaccatgagttaatagcactaaatcaccagacattaaatagccttgtgcttttaataaagataatgcttttttcgcaccttcaatagtacggctgtcatgttcataatgaactggcgttacaccacggtataatgcacaacgatttaacgcttgttcgttacgagaaagtgcatagatcggtaaaccagagctaatacggctcattaattttgcggtttcacctgaatgggttaatgcaatgattgcagaaacaccttcaaggtggtttgcggtgtacattgctgacatcgccgttgcttcatcaatgcttgcaaatttagcttccatacggtgacgtgaaacattgatgcttggcattgtttctgcacctaagcagacttctgccattgattttaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacctaagcagacttctgccattgattttaccgtttcaactggataatcaccgtttgccgtttcacctgaaagcattaccgcatcagtaccatctaatactgcgtttgctacgtccatcacttccgcacgggttggcataggctttttgatcattgattccatcatttgtgttgcggtaattacaacacggttcaatttgcgtgaacgacggataagttttttctgaacgccaactaatgctgcgtcaccgatttccacacctaagtcaccacgagccaccataataacgtctgcacctaaaatgatgtcgttcattgcttcttcagttgcaacggtttcagcacgctctactttagcgacaattttagtgtctaatcctgcttcttttgctaattgacgagcatagtttaaatctgcacttgattgtgggaaagataccgctaggtaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactttagcaccgtcaatagaaagcacttttaattgaacgttaccatcatctaataaaagaatatcgcctggaacgacatcgtttggtaggtttttatagtctaaaccaaccgcttcttgatgaccttcgccttttggtaattctgcatctaaggtaaatttatcaccgatgtttaagaaaattttgccttctttgaaggttgaaacacggattttagggccttgtaagtcacctaaaatcgcaacgtgtttgcctaaacgttttgcaatttcacgcactttttctgcacgagcgatatgatcttcaggcacaccgtgagaaaagttcatacgaaccatatttgcaccagcagcaatgattttttctaacgtattgccacgatctgtagctggacccattgtacaaacgattttggttcttctgagtttacgagacattattcaattactccattgtttaaattgtgaaaaatagaaatcttttatctgttgcttgcaacaacaaaaaacgccgtgcattatacgcctaaaagtgttctgtttaaaccacgaagaggataaaccgatgaatatttggataatgcgacacggcgaagcaggtttcaatgccccaactgatgcacagagaaacttaactgaacagggtaaattgatggcatatcaacaagggcaatggcttgcaaaaaggcttgaaaatcaacaaattaaattagataaagtgattattagcccctaccttcgcacgcagcaaacggcacaagccgtagaacaaggtatgcaagcggtcaacactatgcaaagttttgcaaatcttgcggaaacatgggaagagattacccctgacggaaatcccgacacagtgattgattatcttgcatttctacgagaagagggagcgaagcatgtgctgattatctctcacttgccccttgtctttgacttagtctatcaactaacacagcagagagtacatttttctcctgcggttatagcagaaatatccaaggttgaaggaaaaagccatctgtccgttattgttcctagaaattcacaataaaccctaaaatgtgatcttagtcacaaaatacagttaacggtatctaaactaggaaattttcttattctatttaggggattctctcaaggagcaatgaaataattttcttaaaatttaaatatctttttaaaaatatcagaggaaattatgttttcatttttagctgaagttagacgcccagtcttagatctacccctagaagaaagacggaaaatgtggttcaaaccttttatgcaatcttatttagttgtatttatcggttatatggcaatgtacttgattcgtaagaatttcaacatcgcacaaaatgatatgatcgaaacttacggtttaactaaaacagatttaggacttattggcttaggtttttcaattacttatggtattgggaaaacagtagtctcttattatgctgatggtaaaaatacaaaacaatttgtaccatttatgcttattctttcagccatctgtatgcttggctttagtgctagtatgggaggagggagcattgcactgttcttaatgatttcattctatgcacttagtggctttttccaaagtacagggggatcatctagctactccacaattactaaatggacgcctagaaagaaacgaggaacattttggggtttctggaatttatcacacaatgtaggtggtgcggcagctgctggagttgcattattcggagctaatgtcttctttaatggacatgtcattggaatgtttgtatttccatcaattattgcattaattattggatttataggattacgctatggttctgattctcctgaggcatatggtttaggtaaagcggaagaattatttggggaggaaattagtgaggaagatcgtaatactgaagaaaatcaactgaccaaatggcagatatttgttcaatatgtattaagaaataaagttatttggctactatgctttgctaacatttttctatatattgttcgtattggtattgatcagtggtccccagtatatgcctatcaagaattaggattttcaaaagatgctgctatttccggttttgctctatttgaagtcggggcattagtgggtacattcttatggggatatttatctgatttagcaaatggtcgtcgtgccttaaccgcttgtattgccctaggtctgattgtttttactcttgagttctatcagtttgcaactaatgaatttatgtatttaacggcattgtttgctttaggctttttagtatttggccctcaattactgattggcgtggctgctgttgggtttgtccctaaaaaagcaattgctgttgctgatggtgtaaaaggtacctttgcttacttaattggagatagttttgcaaaactaggattaggaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggacttttccaccgtattttttatagaaatacgctattattaattggaaggattttatgattcatgttgttcttattgatgatcatgtcattgtacgctctggtttttctcaacttctttctttagagagtgacgttactgttattggagaattttcttctgctaaagaagctcgtcaacatttaccttatttaaaacctcatgtatgtattattgatatttcaatgccagaactaaccacaaaattagtttcatctaaacagtctaatccggtagggcaattaacaaaaagagaaagggaaatttgtgagttattaatcttaggttttgaaccaaaggaaataggcgaaaaacttaatttgagttttaagacagtacatgttcatagatctaatgcaataaataaactcaatgtcaaaaataatgttgaattagcgaatttattaaattcacaactaaaatgatatttactatattatactcttggtttttgataacttgttcttatttctgcttatggataatctcagattatttactttcagatattgttttggcctgtctatttttgccgtttgccttacgtagtggtattatattgcatattcaacctaaattctggcctattgtatattgttctgaaattagtatattgattttattaaactatttatttccagaaatatatcaatattctatttttattttaagtatatgtagtatcccaattatttacttatcatatttatactatagtggaaatcaatggaaaaaattatcaattcaacttagcactatagtttcaattagtatgatcaatgctgtagccatttcctcatcagaattttacttcacatttcttgtaagttttactggtggggtattgattgttcctgcttgctatttaatcaatgagtttttatttaagactgaatggcttcctcttacttcttctctaataaagaagccggtaactttaagaataaagcacatttttatttatattttactatttgttttaaatatctatattcaaatgaaattgccagataccttctataggtttgctttattctaccttgcaatccctattatattattagcttttcagtatggttggcaaggtgcatttttaggagtccttcttaatagtatagtacttattggtactacacatagtttttctaatctcactatagctgatttattactatctatttcaacccaaactatcacaggaatatttctagggcttgcgattcaagatcagcgtaacttgaaccagagtttatcaatagaattaaataaaaatagattactcactcggcagctgattaatactgaagaaactattcgtcaagaaatctctagagaattacacgatgaggtcgggcaaaatattacagccattagaactcaagcaaatattttaaaaaggattgcacctgattatgaaaaaatatcaaccacaatagagcaattatctcttaatatttatgatacaacaaaagtactactaaatcgaattcgacctcgtctacttgatgatttagatttaccccaagctattgagaatctatttattgaactaaattttcaagataatcaaattgatactgaattaatatggaaaaatgatcaaaatttaaaattagaacatattcttgaaattactatatatagattatgtcaagaaagtttgaataatattataaaatatgctaaagcaaataaggtaaaaatagaaattgaaataaaaaataatatacatattattattacagataacggggttggatttgatacatatcagatattaacaggatttggaattcgtggaatgcaagagagagtgaatattttatgtggtacatttgaaattatctctattcctattgaaaaaatccaattcaacatggaacaacacttaaagttaatttaccttacgtataaaaataatggaaaatcaaagtcataaaatttatcactactggcgactacatattatgataggaatgtatattggttatgctggcttctatttgactcggaaaagctttaattatgtcgttcctactctaattactgatttaggcattgataaaaataatatagggataatctcaacattattctacataacctatggtatttcaaaatttatttcaggtgtttacctagataaagaaaatcctaaacattttatggcttatggattatttcttacaggaatcacaaatatattatttggcctatctagctctgttctcatgtttactatattgtgggttattaatgcttggtttcaaggatggggatggccctcttgttctaagttactaacaacttggtattcaagaaatgaaagaggcttatggtggtctatttggaatactgcgcacaatgttggtggagcgatgatcccattaattattggttatctcaccttacattatagttggagatatggatttatcgccgctggaggcttagcaatattaatcagtatattcctattttttcgattacagaatactccagaaaccatgggattacctagcataggaaaatggcgcaatgataacttagagcttgctcaagagaaagagggtaaatatctcacatggaataagatcttacatcaatatgttttttttaataaatacatttggctattagcattaagttatgctcttgtttatgtggttagaactgccattaacgattggggaaatatctatttaactgaaaaatatcactatgatcttgtttctgctaatagtgcactttcactctttgaagtaggaggatttataggatctctagttgctggttggggatcagataaattattcgctagcaatcgtggtccaatggcattgttatttgctattggtatttttttctccattattgcaatgtggcttatgccaaaagaaaatttcatattacaagcaggaattttcttttcagtaggttttttcgtatttggtcctcaaatgcttattggtatggcagctgctgaatgttcccataaaaaaactccagcttcagcaacagggtttgtgggattatttgcatatttaggtgctgctatagctggttatcctttagcattagtgatggaatcacaccactggtccggattttttgtcgtgattgcttgtgcagcctctggcatcgcattattgctattgcctttccttaaagcacaaaattgacaaattacctatgagtaaataaagcaattagtattttgggataaagccgaatagaacaccgactcattcagtgatttggttaaagatacggataataaaaaagtggcttagcgccactttttattagaataattttctagaggtattaaagatttcttctttaaacggacgacgcatattggtgattgcatcaataatatcgtggtgaactaatttttcattttgaatacccacacaacgaccaccgtagccttgcatcaagagttctactgcataaacgcccatacgagaagctaaaatacggtcaaatgcacaaggcgcaccaccacgttgggtatggcctaacacagcagcacgggtttcgtggccaaagcgttcttcaatctctctcgctaattggtgtacatctgtcattaattctgtaatcgcaataattgcgtgacgttttcctttattgaaaccatcttcgatgttgcgtattagtgactctttatcaaaacctttttctggaatgataatgtattcacaaccgcctgctaatgccgcacttaaggttaaatcaccacagtggcgccccataatttcaacgatagaaatgcgttggtgagaagttgaagtatcacgcaagcggtcaattgcttctaatgcggtttcaagtgctgtttggaaaccgatagtgtaatccgtgcctgcaacgtcattatcaatagtgccaggtagaccgatacacgcaatgccgtgttcttcggtcaatagttttgcccccatataagagccgtcaccgccgataactactaacgcatcaatttcatattttttcaaggtttctacacattttgcacgcacttctggatttttaaattcagggaaacgtgcagaacctaagaatgtaccgccacggttgatcacttcagacactgaacggcgttcaagtttgataacacggtcgtgatataaaccgtaataaccgtcttgaataccatacacttctaaaccttcacttaaacccgcacgcacaacaccacggatcgctgcattcataccaggcgcatcgccgccactggttaatactgcaattttttttaccatatcaatacctataaatttaattttaaaaaataaatcaaaaaacttgcaaagattaccctataacgccctttcgttctagcagaaaatcgggaaatttacgattttttgatctaagttgagattaattttctaaaatgtcgagagcaaaatctaatgcggtaaaaaagcggtcaagatccgcttgcacattgtaatgagcaagagatattctcaaggtgccattttgtgctaaataacgtaagtagggtttggcacaatgttcaccactacgcaatgcgatctgttgctcggctaaaatcgccgcaatatctgcgtgatgttgatgatgaaagacaaagctaatcgttgggcttaaacttccttccgctaaaatgcgtatatttggataagctgctaaccgttggcgagcctctttagcaagctgataaagcggtgagtttaaggctgaaaaatcccatttttccaaccactccagcacctcaccaaaagcgataattcctgcgatatttggtgttcctgcttctaaacgataaggcaatgttgccatcgtgagcttttgctcagtaatctcttgtaacatttttccgccaaataaaagagggcggagttgctcaaggctactcaatttccctgttaatacaccaaccccggttggtccgtacatcttatgtgcagagaacgcatagaaatcggcatcaagtgcttgtacatcaatttgttcacaacagaccgcttgtgcaacatcaagcacaattttggctgaacattgctgacgaataagcggtatcaattgctctgcaggctgcctaacccctgttacatttgacaccaaattaaacgcaacgattttagtgcgttctgataaggctgtttgtagcatttcaggggcaatttggtagtcgctattaagcggtagcacaatcaacctcgcttgtttacgctcagcaagttgttgccacggaataaaattagcgtgatgttctgccacagaaatcacaatttcatcaccagcttcaatactgtcagctaaaccatttgcgactaaattaagtgaatgggttgtgccacttgtccagataaccgcatctcgtgttgcaacattgaaacgttttgccactaaatcccttgctaattcataacgttgcgtttgaggaaaatcatattgactacggtgaaccgaaccagatgaacgataaaaattgagcgtttcgtctatcaacactttcggtttgagtgttgttgcggcagtgtctaaatataccgcatcgggactatcttgaaaaaaagggaaatgggaacgaaaagtatgattaatcattgtcgctgagcctttctataaagtttattacaagggataccatcattattgccgtctagctctcgccaacggcattgtttaaagtagcgtttcgccgtgtcataatcgggaagatcgttacaacttttcctcacattacaatctatagtggcaagcggtgccttaggcgaaaaaccttgccaaaatgaatgttcatccgaccgcttacttgcacgccagtccgcaggattgatcggatttttatcttgccataaacctattctttgctgttgagcaagttgttgagcttgcagatacacaggttgtgtttggcgatacgcccacgccattcctcgttgcacctgaattaagttaagattttcacccgtctgatcataaaccactgccaacagccgttgatatttatcataccccgtaatctcaagttcaacctcttttttaaatgccagttgagctaacgattgcttcgccttattaccaaaaggctgggcaaattctggggcatcaatatattgcaggcgtactttaagttgtgtccgattgtgcaagcaggttaaagtatcgccatcataaatacctacaactatacatattttctgtgctatatgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggttcatttgaaaaaaatagagaaagtaatattgctaatttatggtagtaaatagtttttttcatattttaagtaatatttaaatagaaggctatttgccatttataaaatgatatagataatagaaactatgtatttagcccagcatgctaataaaaaataaagtaatgctgattaggaaaacgattttctaatatagtaaatacatgctattctaggtcaattgtagttgttacattcaaaattcagactaatgaaaccaattttcttagagcttcgtcatttacgaactattattgctttaaaaacagcattatctcatcaaattaaattgttagaagatcaatatgatctaactctatttgaacgtaaaactcagccaatccattttactccagctggagaacgtttagtacagctcgcttatgaaattttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaaaataatagaagctgaatcagatataacccgaattaaacaaggagaagttggagaattacggattgctgttgaatgccacacttgttttgattggttaatgccagcaatggatatttttagacaaaattgggggggaatagaattagatattgtgtctggttttcatactgatactgttggtctattgcttactcaccgagcagactgggctgttgtatcagaaatagaagagtccattggtattatttataaacctttattttcttatgaaatggttgctatttgtgccaaagatcaccctttggctcaaaaagaaatttgggaagctgaagattttcgtcacgaaacactaattcattatcctgttcccgacaatatgttagatttattgaaaaaaatcttacaaccagtaggaataaacccaacaagacgcactagtgaattaactatcgcaatcattcagcttgttgccagtaaaagaggtattgcagccttaccttattgggctgtaaaaccatatttagaaaaaggctatgttgttgcaagaaaaatcacttctaatggcttatatagcaatttatacgcagcaatcagggaaacagatctagataaagtttacattgaagagtttcacaatatagtgaaatcgcaaagctttgccacattattagatctattttctttagattagaaatattatttatgagtacaccaatttcccatttagatattttaagctaaatgggatctgtaataattacttatctgctactgatactttcagcttttgccgttaagttttctgcacccgtcgctctcatcacaatgttatcttccgtccgaataccgccgtagcgtttaaattcgtcgattttctgccagttaaagaaaggtgcaagcgggtggtttttccattgatttagcaacatctcaataaaatagaacccaggttcaatggtaagcaccataccttcggctaaatcacgagtgcagcgcaaacttggataaatctcaggcggagctttgcgtgtgccacggtgattttgttggaaacctgcaacatcgtggacttgcaaaccaagctgatgccctaaaccgtgtgggaagaaagtacggctaataccctcttcaaaaatttgatcggcaggtaatttcacaaactcaaactggtgaagcatttgcgagatccaacggtgcatttgggtatggtaacttagataattaatccccacttgcatatcagcaatagtatccagtttaaactgttccatttgagcaaccattgtggcaaattcactttgtggctcaaaagcataagttcgagtaagatcggaggcataaccaagatagcttgtgccagcgtcaagtaaaaaactgtggcgttcgcaaggtggtgtgaaatccaattttgtgtaatgtaaaatcgcactatgctgattgacggcaacaatatttccataaggcacattgttatccgattgcttggtcgcttgaagataggctagattaatttcaaactcacttttaccggcaaagaaagcctcttttgccgcgtgatgtcctgttaaagcggtgagttgagcttgatatatgcactcaatttcaaattcgcttttgatcgaacgctcaaaatgcagtacatttagcattttctgtggattgatatgctcaaaacctagcgatttggcaagctccgtttgttcaccaataaaggcacaatgggtcggattaaggatatattgttgaatttgttggctatccgtgagcatttgccattcaaactcatcagcaaaaaatgccgatgtcggcggatttggcgtacaatgccaataatcttgcggtgcataaaaatagagtttcggtttatttttaccgtctaaaaaaagccaactttgttctgcggtgggatcagggaaaatataattaaaatgcggattgattttaaatggcgatgtttggtcgtctaaaaaatgatattttgcctgccctgcataaatccaaagcccgtcaagacgagccagctctaaggcgtgctgtacgatttgttgaatacgtgcgatgtgttgagagaaaagctgttgcatatatatcctgtaatttttaattttgaataataacgatgaccgaactaaccattaaccacactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataccctagggctacgttgtcctgaacctgtaatgcttactcgcaaaaccattcgcaatatggcagatggtgaagtgttgctaattattgctgacgatcctgcaactactcgtgatattccgagtttttgtcaatttatggatcatcagctattaaaaagtcaaacagatactaagccgtatcaatattgggtgaaaaaggggttagaccacctttaaactttttgtaatttcaaatctatcatctaaaaattctttcttcagacgagatatttctccaagtatctcttcttcagaagatagaatattatcatctttacgtaatagttgattatgtgctgttaaaatagtacgtacatatttttcccactgtttctctggaattttctgtacatatgcagataaaaagagtaattcaatattagaataataaatcccaccacctgacacaggacttgccagatagttaacgttattaaaagcaaaaggattatccaatatagctcggttaaatttctggcaggaatttgtagctgcttctattgtttcagccgattgagtaatgacaacttcttttcgagctactaatagggcaattattctaaataatgcatttggaggcatatccccttttaaggcttcacacaaagattctaacgagtgaatcttataatcagataatttttcaataataggttttaataattcttctttaaattccgtttgtcggtagtttttaatcgtggtcgaaatttttgttgtagatgaaacaagtaatatatttaatttcttccattctttctctccttgttgattagtaagttgagattttcctttaacccaataatcacggcggaattgtttatttaaaataaagtcttttgctgtttgaaataaagaaggatcttgaatgctagataataatttttgttgctcttcatcaaataaaacctcatcaaaatcatctaaataagaaacggagcatgcgtaacttaatttagcttgtttcaagcaggattcaatttctgaaaaatacattggataccaattctgattagtaaattcatgaatgacgtaattagaattttgttctttgatctgttcaacttgttccaacaaataaggtgagagagaaaggagactattactcactgaaagcatattctttgtatgttctaatgctgatttaatcgcttgatcttttgattctagagtagcagataatttactatagtattgatttaataaatatctaattggtgattttcctgcccatcctggtaatgtgttatagctaatatagactacaccacctacttttaatttacgttgaataaaatcaacgatagtttctctattttgtggtgaaatccaagaccaaataccatgtagagcaataaaatcaaaatcaggtaagtcatctcgatgacaaaattcggcaaaagattgatctgcaataacgactttatctggattgccttggtttgctaattgttgagcaaagaacgcatgagaaggattaaaatcagtcccgtaccattttactgttcctgctactgcatgaatattaagcgatacaccaaacccaaaacctaactcacacgcattaatgacttttggcggctgtaaatttgctattaagaatggacaaattaattggtggctatttaatccatcgtaataacctgtcgtataattaatatcattaacataaccttctgaccaatttgttagcattgctcctccttattacttgattcttacatggtaaatattctacatagggttatcatttattttcataattctgctaatggttaacgtctttcatcatcaaaatcatcatcttcgtcatcgaaaaattcgtcgtcatcaccatattcatcttcatcactgttcggatcttcaaaataagttccccagccttcgtagaccgcacccgatttttcgattaacggcagtagctctttttgttgagcggtaataagttccgcatctagtttaatttcgctgacaatatcgcacacaaacacaagatcgccattctcttcttccacttcttccgcttcagaaatctcatagcccaacttataagcatctaccactaatttttcgagtttatcgaaatcgtggtgagcaacgtggtgttcgataatataaagggcttcaggatcgctgccatcgtctaataaagatttgatgatttcatcggtttcttggcgtaattcggttaagttgtacataagattagccctcttgggtttgtgtaaaaatttcggcgaaccaactatctaatttagtcgcaagtttatcaataccaatacgatttaatgcagaataggcttcaacttgcacatcgccttgaaacggtaaaatcgcttcccgcaccattttgacggttttgcttctcgcactttggctaagtttatccgctttggtaagtagcaataatacaggcaactccgcagataccgcccactcgatcatctgctgatcgagatctttcaacgggtggcgaatatccattaaaatcactacgccccgtaaacattcacgtttctgcaagtattcacctaaagaacgttgccactgaagtttcatctgctcaggcaccgccgcataaccatagcctggtaaatcgactaatttacaatttggttctacttcaaataagttaattaactgcgtacgccctggggttttagaggtacgagccaagttcttttggttagttaaagcatttaatgccgttgatttccctgcatttgaacgccctgcaaaggcaatttccacgccactgtcttctggtaaatggtgaatatcaggtgcagaggttaaaaaatgggttttgtggtagttaagttttatttcagtcattttgtatttgtttgttattaaaatttgtaactagctcccctctttgaaaaagaggggctgggggagatttaaaaaacagttttgtagggtgggttttaacccaccaataaattcaagagattacaacggaatggtgggtcaagacccaccctacaattatttaaatctcacactcaatcttttctcaccatattgattagcttcaggatttcctgcaaaaacaccccattccatcactaaaatcgttccgataaacatcggcatcataatgcctagcacaaatgccattgttccttgcgatcccaatgaactgagataacacaatatcggcaccgcaaccataaacaaggctttcgccgaacgattacggtcgtgtaggcgtttaacgatcactgcagataaactgtaaagtgaaagggtcaagggtagaacgctaatccaactgaaagcggtcggatttaagataaaatttgcaaaaataaacaaaaatgcaaaattaatcccaaagccgatccaaaagcctttgcggtttaaccttccgtgaaaagaaaataatgctttatgccagatcattactgcaatgccttttcaattttttcaaacaaatcacgagcaagattatctaaacctttcaaacgctctaagccgcgacgcatcagggtttgacgttgagtgtcatagcgagaaagtttaattaacggctcaattaagcgtgccgccacttgcggattgctttcgttcatcttaatcaacatatcgactaagaaacggtagccagagccgtcaatagcgtggaatgcacttgggttttggcttgcaaatgccccaactaatgaacgtacacggtttggatttttgaagttaaaacttgggtgcgttaataaattttgcacaatttcaagcacattttcatcaggacgtgtcgcctgtaaagcaaaccatttatccatcactaagccatcgtgttgccatttttgttcaaaatcggcaagaagctgatctcgacaggcaagttgtgctttggtcgaagccgtgagtgcagccaaagtatccgtcatattgtttgcttgatgataatgtttgtgtaccaaggtattacccacttcggtaaaggcaaggtaagacaagcagacattgcgtaatgcccgttttgccaaatcctcggcaaccacacggtattccgttaatttattttggttgtaaacgactaagaagtgatcttttaattcatcagcaatcgcttgttgcataaattgacgaacagccgcaatacctgcaggatcgatcactttaaacaactcagcaaattccgtttcttttggcaaggttaaggttaaagcggcaagttcaggatctttatttgcattatcgatcacaaaggtgagtgcttctaacaaaccttgtgagaatgccattgcttcgccctgttggtagcgacttagattttcacgcagctcattgttaaacaacatttgtgccacgtcccagcgcacgaaatcattctcagcaaacttcaagagcgttaaaagctgttctgttgaatagtcataatctaaacgcacaggggctgagaaatcacataacaaggcaggcactgggcgttgttgtacattgtggaactcaaaggtttgatgttcgtggaccacatctaacacatcactgacagttaataattcgtgttgtaaattgattttcttaccatcttgaccatataacgctactttcaacggaatgtgtaaattcactttctcaagctgatcggcggttggtggtgtgttttgagaaacgtgcaagcggtaagtatgacgtttttcatcatactcatcagaaatcgttaattcaggcgtacccgattgactataccaacggcggaacagatctaaatcaactcccgaagcacgttccattgcagacacaaaatcttcacaggttgccgccgtgccatcattttctgccacatagagtttcattcctttttggaaacgctcttcgccgagtaaggtgtggatcatacgaataacttcagcccctttttcatagacggtaaccgtatagaaattattcatttcaatcactttttcagggcgaatagggtgagccatcgggcttgcatcttcggcaaattgcaccgcacgcaacaatcgcacatcttcaatccgttttgccgatcttgaccataaatctgaagtaaattcttgatcacggaaaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcgtccgttgcagtttgcggattagccagcacaaatttcgagttaaaaatgtttaaccccttattttccattgcccccatattaaagaaatcgaccgccacgatcatataaatgtctaaatcgtactccagcccaaaacgctcttcgtcccatttcatcgaacgttttaaactctccattgcccaagtggcacggtcaagatttcctttatccacatagatttcaagggcaacttcacgtccgctcatcgtgataaacttatcttgtaacaggtcaaaatcccctgcgactaaggcaaataaatagcttggtttaaagaacggatcttcccactccacccagtgacgaccatcgtccagctccccttgagcaatacggttgccgttagaaagcaggtatggatatttacttttacaagcggtgattttggtgcgatattttgcaagcacatcagggcgatcaagcatataagtaatctgacggaaaccttccgcttcacattgcgtgcagatcccttcgcctgattgatataacccttgtagtgacgtatttgttgatggattgagttttgtctgaatttccagctcgaattgatccgcagggaaatcggctaaatttaaagtcaaagcctcatcatctttttgatattctttgaatggctcgccattaaatttaatcgataaaaattcaaagctatgcccatctaaacgtaacgtagtcgcttctgcatttttacgcatgaccgacaacgtcgatgtgacaatcgtctgctcaggatcaagctgaacatcaagataaatttgatgaatcgtaaaatcaggctgacggtaatcttttctaaattttgctttaggtcgcatagcttctcccttagaactttcaaatgtggaaaggataagaatatttgtctttaagtgcaatcaaatttaagatcttgccccaaaaatcgccgtaccaatacgcaccattgtcgaaccgcattcaattgcacttggcatatcatcagacattcccattgatagcgtatcaatcccttcaaattgagattgtaattgaagaaacagttcattcatttgagctaaggcgattttctgttgctcaggctcactttcaggcttcggaattgccattaaaccacgcaatttcaaacgtggcagttggctaatttgagtggctaattctagcatttctttcgcagaaatacccgatttagatgcttcatcactgatattaatttgaattaaaacattcagtacaggcaggtgttcaggacgttgctcgcttaaacgttgtgcaattttgagcctatctatcgtttgtacccagtcaaaatgctccgccactacacgcgttttattcgattgtaataaaccgataaagtgccattctaatgtgtcgttctccgcaaaatgctgaattttttcaataccttcttgcacataattttcgccaaaggcacgttgccctgcttcaatggcttcggcaatggctgaaatgggtttagttttgctcaccgcaagcagtttaacactctgttcagggcgattagcttgctgacaatattgttgaatttgttgagaaattgtcgctaaattttgagaaatcgacattggctactccaaaaggctataatgggcaagatcataaaactccacttaactgaaatcaaggatacttatgcaaagactgacaaaaattaaacttgtgattaccgatgtggacggtgtactcactgatggtagcctttattacaccgaaaatggcgaagcattaaaatacttcaatgtgaaagacggtttagggattaaaatgctccttgcttgtggtattcaagttgccgtgctatcaggtggtgacaccccgattttacgccgtcgcatcaaagatttaggcattccccttttccaacttggcaaaatgtctaagcgtgatgcctgttttgagttaatgcaacaagcgggggtttcagccgaagaaactgcatttttaggcgacgatacactggacttacccgcatttgaagtctgtggattagcagttgccgtgggcgatgcttttgattatgttaaaaatcaggcagatttagtcttaacgcgtaaaggcggacattccgcattccgtgagctttccgatatgattttaaaagctcaaggcaaagaagaagtttatgctactgctgatgggtttatgaaagtggtgcatgaaatgctacaataaataatatcctgtggaattttagataattaattgaaaaagatgagccaacaagacaaacaaaatttaatttggatcgatctcgaaatgacagggcttgatcctgaaaaagagcgaattattgagattgctaccattatcaccgataaagatctgaatattttggctgaaggccctgtgcttgccgtacatcaacccgatgaattattaaataaaatgagcgaatggtgtgtgaaaacccatactgcaaatgggttggttgagcgtgtgaagcagagtaaattaactgaacgtgctgccgaattacagacattagatttcctgaagaaatgggtgccgaaaggggcttcgccgatttgtggtaacagtattgcacaagataagcgtttcctttataaatatatgccagatttggcggactacttccactatcgccatttagatgtgagtacattaaaagagcttgcgagccgttggaagcctgaaatgcttaaacaatttagtaagaaaaacagccacttagctttagatgatattaaagagtctatcgaagaactgaagttttatcgtcaccattttattaatttagattaacaataatgcaatcattttattttgcaactgaagaagaaatgctcaatttcggtcagcgttttgcccaacaacttcaacgctatttagaaaatcatagtgaaaaagcgattgtgatttatctgaatggagaattaggggctggaaaaacgacgctcactcggagcattgttcgtgcttttgggcataatgggaatgtaaaaagtccaacttatactttagtggaagagtatcagcttcccccttatgctttatatcattttgatttatatcgtttgagtgatcctgaagagttagaatttatgggaattagggactacttccgtccacaaacggtttgcttactagaatgggcaagtcggggggaaggaatgatcccatctgcggactttattattcaaattgactatgcagaaacagggcgaaatctagctcttatgcctcaaaacaactcagcaaaacagattgtagattatttagaacatcagaccgcttagggtaatactatgcagaaattacgacattatgtttgttttacggtaatgagtttatttcttgctctttccgcacaagcaaaattaaccattgccattgatgctggacacgggggcaaagatccaggggctatcggtaaaaatttaggggttaaagaaaaagaagtgactttagcgattgccagagaactaaaggcgttgttagatgcagatccaaatttcaaggcagtaatgacacgcaatggcgactattttatccagttacctaatcgaactgaaattgctcgtaaaaataaggcaaattatctagtgtcaattcacgctgattcttcaccaagttcagataatctaaaaggggcttcggtttgggttttatctaatcgtcgtgcaaatgatgaattaggaaaatggttggaagatcacgaaaagcaatcggaattattaggtggggcaggttcggttttagcaaataataatgaacgttacttgaaccagacagtgcttgatctgcagttttctcacgcacaacgttcaggttatgagttaggtaaaacagtcttagacaaactgcgaaatgttacgcaattagcgaaaagttcgccacaacacgccagccttagcgtattgcgttcccctgacattccttcaattctagtggaaacaggctttttatctaatgcaacggaagaacaacgtttagctacaaaggcgtatcgccgtcagattgcaaaggcgatttatcaaggattaattgcatataaaaatagattaccaaaacagccaaatcaaatagcagttaatgatgaaaaatcaaccaagaaatcgaaagctgaaaaaaaggtagagaatcgctctaaagaagataaaaaagctaaagcagcggtgacttcgcctaaggaaaaaactaaagagaaagcaaaaataacgacgaaaactaagcaagaacaatcgtctaaagcgtcagaaaaaacggttaatctcaatgcgaaatatcatgttgtccagaaagatgaaacactttattccattgctcgcatgtataaaacaacacctgaaaaattgaggcagctaaatggtttaaaacaaaataaaatctttgtagggaagaagctgcaagtaaagtaaatcaatatagtagagtataaaatttaaaactggatatgggaacctagacaaaatagtagataaataagcatgatatttaaagaaaagccgattatttctaatcagcacggagcattagtgatggcatttgtaccatttatttatggtatttctgctagccattttgtaatgaatcatttttggcttgggcttagctggctttttacttatctcttttcccatccttttttctccgtcgttagcaaaaaacaaaatgaaaaatataaacgctggatgattatttatgccgtatttagcggcatatttatatttccggtactcttaagtcatttttctattttgcaatttataatcccaatcctgccgcttgcaggggtccaaatttactatgcaaaacaaaaagatgaacgaaacttaatcaatgatattgcaggtattttaaccttcggcataattggaatggcaagtttctatttagcaacgaaccaatataattttgagattttactccaccctacgttattttttattgggacaacaatttatgtaaaaagcgttgctcgagagcggaaaaatcctctttactgtaagttcagtataggacttcattgtatatttatctttgtttatctcgccttaggcgattatggcattagctttgcctatttcattgggttaattagagcggttattgtgccaaaaagaaactggaaaattaaacaagtcggcctatttgaatttttagtgatatttgtttttacactagggctgatctactaaatgtattaacctaataatatccgttatttctctttccaatatccaatccattctttcagggcgtgcatattgctatgtaatgctcctgattgtgggataaagtaaaatacatttaatccataggtttcaggcatttttcctgctccaacacttgcaggtaatatcttaaaaccttctcgctcaaatagcattcttgctcgttgcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccactggtttgtcactagcacaatcttattaataccttctttttctaaaataggtttagaaaacttcgcattttcagccgtcgttttggctttttcttccaaccattgtgttggaatatggaaaaattgttcgagctcttttttcatgacggcagcttctgaagtcccttttgggctacttcccgtaatcaataaaggtaagcccgtttctttttgtaaaaaagcagcataacgtacccgctctaatgctatttcgctgatcgctaatttgccaaataactctttactatcacgcaagccaccactaagtaaaacgatagcttgagccgatttataatcttcaatactaaggttatcttccgttaccagagaatcatgcaatttttgcgaagtatagggaatactgaaaatatagagcattgctacacctaaaaaagttgagagataacctaattttttccattttaagcggaaacaaattaaagaaaacaaccataaaatcagaatgttaaatggtggaagaatgaccgcagtaataaattttgtgatagcaaacataatgagtaggcaattttgtcaagtaagtaaaagagatttattattcctcattccttttccgttgtctattgtttaactcgctctttaaaattaaaatggcaagtcttattaaccatattactagcggttagatttatgaaaaaaattgcaattattccagccagagcaggctcgaaagggattaaagataaaaacttacaattagtcggcggaatttcgctcgtaggccgtgcagttctagcagcaaaagagtctggaatgtttgacttaatcgttgtcacttcagacggcgaacgtattttacaggaaggtgaaaaatatggtgcaacaccactacttcgccctgctgaattggctcaaagtgatactcgcactattgatgttattttgcactgtttagaaaccttaaacattcgtgaaggcgttgtcgctcatttccaacccactagcccacttcgcaatgcgttagatattcgcaatgcgatggaaatctttttaggtggaaaaagtaagtctgtggtatccgcttgtgaatgtgaacaccacccgtataaatcatttgttttaaatggagatgatattctcccgatgaatgaaatcaaagattttgaagcaccacgtcagcaattaccaaaagcataccgtgcgaatggggcgatttatatcaacgatatcgccagcctacttcaagaaaaatacttttttattccacctgtgcgtttctatttaatgccaacctatcgctcagtcgatattgataccacattagatttgcaactggcggatagcttgattgagaaagagatgcaatgagagccatcaaagacagtgcagtttatttaatcggtgaactgacttcacgggcaatgccattttccaagccttattaggtgttcagctgagcattcgacagtgtcaaaaacaggcgatttcctatgccattttgcaatttgcttctagcttaggcactgctgtttttacggtattacttctcgaactttatcaaacggaattggtcgaaaaaagattatttgggattttattaggcaatgtactggtatttttattagcttacctgatttatcgtaaaaaaagtgcgagtaaaaaatatcaatggaagcaatataaatctgcacttttttatgtgcttgcttttggtacgccattaattttgcataatgtcagttttttcttaaaagggcagttagatcgtgtatttatttatcatcaatttaatcaagttgatttaggtttatatgcgatgggggctcaaattgctgcgatattgatgattattttacaagcagtaaataaagcactcactccctatttttttgatggattaaaacaaggtcgaattaatttaaaacaaacgcaaaatgggcattttattccttagccattgttccgttaccttcattaattatgttagtgttattaatgtttttatctttatttggcaatgaaggtaaaaataaaattctatttttaaataacaagacagaaaatgtttagtattattattccttcttataatcgaaaaaatgaaattcctgcattattaacaagtttggaatatcaaacggaatataattttgaagtgattattgtcgatgatcactctgttgagccagtagaaattaaacatctctacccatttcctgtcaatgtgattaggaatgaacagaatttaggagcagcagaaagtcgtaatgtaggagcaagatttgctgaaaacgagtggctactctttttagatgatgatgatcgttttgctcatccaaaatgtgaaatactggcaaaaacaattaatgaaaacccgacgattaattttatttatcaccctgctgaatgtgtgatggtaaatgaagggtttagttatatcactcgcccctatgaaaatgaacaagcggtcactttagagaatattttactggcaaataaagtaggtggaatgcctatgattgcgattaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaaatcatttttctttgcagtcaatggattatcaacggatttaaaatctttagaagactatgattttattttgaaagtgatttctcataaccagtttaaaccaaaatatgtttctgaagccctaacaacctgtactttccatactaaacgagcaagtgtatcgacaaatacacaaaatactgaattagcgattgaaactattaaacaaaaatatgtaaaaacagatattcaacaaaaaaactttgcttttaatgcattatatatgctttcttacccacatataatgaatttatctcgtaaagcggcttgttattattggcagatgttcttacaaagtaaaaatattaaacatttggtgattgctaccctcacatttatttcaccaaaacttgcaatcaatatgaaaaggtttatttaatgaaattttccgtattaatgtccttatattttaaggaaaaaccagaatatttaaccgaatgctttgaaagtttaaaaaatcaaacggttcaagcggacgaaattgttgttgtatttgacggagctattacccccgaattagaacaagttatgcaaaattttgcggagatcttaccgcttaatatcgttagacttgagcaaaatcaagggttaggaaaagcactcaatcatggcttaatccactgcataaatgaatgggtattccgtatggatacggacgatatttgtattccagaacgttttgaaaaacagattgcgtttattgaacaaaatcccgataccattatttttggcggacaaattgctgaatttggctcagatattaatgatattgtcagctatcgtcgtgtgccaacagaaaccaaagccattgtggaatttacgcagaaacgttgcccatttaatcatatgacggtcgcctaccaaaaaagtgccgtgcttgaatgtggtggctatcaagacctacaagaagattactatctctggattaaattggttgcattaggcaaaaaagtggcgaatttacccgaaattttggtttatgcccgtgttggaaatggtatggtcggtcgccgttgtggtatcgctcaggctaaggcagaatggcgtttatttaaattaaaacaccaagtgggtatgcaaaatgttgtttcaggttttatcacttttactatgcgagtgataccgagattgttgccaacagtcttacttactcagttttataaattacttcgtaaataaaaggtgtaatatgttgtctatacaagatttttcaaataaaaatagttgctaatatttagagaaaataaatattagcaactattttgtctaccatgccgattattccttatgaagagcgataaacatagttaattattctgttttaagcgataacgtctatccatcatacaaagtatgccacctatcgccataaacaatccaccgaaccaaatccaacggataaacggtttgtagtataaacgtacgccccaagagccatcttctaaacgttcacctaaggctgcatagagatctcgactaaatccccagtcaatcgcagcttcagtcatacccattttactgacattgtaaaagcgtttttctgcgtgtagtgtggcttcatatttaccatttcgatgaatttcaatatccgctgtgccaccaatatagtttgccccatttgagtcacgaatacccttgaaggtaaagttgtaatctaaaatttcaactttgtcgcccacattcattcgtacatctttttcgatactgtaattttggctaaaggtaataccaaacacagtcattgcaacccctaaatgagccaacaccatcccccaatgggaacgagaaagtttcaaaatgccttgcaagaaactatgacgatgcgttgctcgttgatgtagttcatacaaactcaatgccacgataatgatggacatcattgtccctaataccacgctgacagtaattttgctggcaaaaagataaggtaagccaaagccaagcaataccattacggctaatgaaatgaggactggcttacggatagcagaaacctgatctcgacgccattttacaagcggtccaattcccaataaaaatgcaaaaggcaccattaagatcataaacatctgatcgaagaaaggcgctccgatagaaattgtccctaaaccaatttgtttatgaattaacggtaaaatcgtgcctaaaaagaccaccgataagaacgccattaatagtacattattgagtaataacattgactctcgtgagtaacgttcggaattgtctaagctcttgattttactgccttgataagcgtaaagcagtagcgaaccgccaataaccaccacgagataagccaaaatatataagccccgagttggatcagacgcaaaagcgtgaaccgataccaaaatccctgaacgcactaagaatgtgccgagtaagcagagtgaaaaggcaagaatagctagcaagaccgtccacgctttgaaagtactacgtttttccgtaaccgctaaagagtgaattaatgcagtacctgcaatccacggcattaacgaggcattttccacaggatcccagaaccaccaaccgccccagccaagctcgtagtatgcccaccaagagccgagtacgatacctaatgttaaaaatacccacgctgccatagtccaaggacgtgaccatcttgcccaagcagtgtcaagacgacctgtcatcaacgacgcaatagcaaaagcaaaggcaacagaaaagcccacatagcccatatacagtaacggagggtggaagattaagccaacatcttgcaacatcggattaagctctcgaccatcaacaggaaaatcagggaaagttcggttaaacgggttagaagtaaacagaataaagactaaaaagccaatgctaaccaagcccattacccccaatacacgagcgatggcttcttcaggcatttgtcggctgaatgtcgcaacggcaacgctccaaagggaaagtagccaaatccaaagcaacaaagatccttcgtgagaaccccaaacagcggaaaggcgatactctaacggtaacgtactgtttgagttattcaccacatactgcacagtgaaatcattgaccgcaaacagataaaaaagcgagccaaacgagatagataatgctaaaaaaaccgcccacgtcatcggacgagccaatgccattagactagcattttgtttatgagcgccaacaagcggtaagatcgccaataaaattgccaatgcgagagcaagagcaagggtatagttacctaattcagcaatcatttattttctccaaacggctgagagatctgcgttgcatcacgttctgattttcctttgagatctgcttctgaaatccccatcggctgatgttgctttttcatctgatcgcctaattcaggtggcatatagttttcatcgtgtttagctaacacttcggttgctttcagttttgtcggctcaactaaagtaccttgtgccacaatcccttgcccttcacggaataagtcaggcaaaatcccttcatattccacctgaattgcaggcccaatatcattgagatcaaaggtcactttaagggtcttatcatcacgttttaccgacccatcaaccaccataccccctacacgaatacgttgcccaacttcaggcttggtttctggatcattatttttaccatagataatctctgatggcgtatagaataagtcaatgttttggcttaacgcatataaggttaaaccaacagcaacggcaagcccacttaacactgccatcaccactttcagtctagatttgcgtcttgggttcataaaaacctcgttgtaatcactcaaaaaacaaatagaaaaattaaagtgctatcctaacaaaaaatctgataagaatcgttaaatattcgattattttattctttagtatataaaaatcatgtctaccctaagacaggaaatggtcgaacattctctaattgagaatgtatttgattaggtacggttgatcctaaagtccaagaaataaatgatatagagcttagtataacttaatttactacacagaaatcccacaagttgggtcgtttggagccattctaacagataattttgggcaacatatagtttattacttagagagataggagtgtttataagcaaggcagaactcattacatctcaatatgaaaggtttccaagaaattatactgcctctttcgatgttacttgtgtactttaggggatgccaaacatagagagaagcaagaactgcttgtttttgaacataaatataggtagaaataaccgcaccttattgttataagttgcggttattttttgctacttataaggctttcaaaatatcatccacacgttcttttgcatcaccaaataacatttgggtattttctttaaagaatagtggattttgtacgccggcataacctactgccattgagcgtttgaacacgataacgttttgggctttccaaacttcaagtactggcatacctgcaatcgggctatttggatcgtccattgccgctgggtttactgtgtcgtttgcaccgataaccaagactacgtcagtatctgcgaaatcatcattgatttcgtccatttctaatacgacatcgtaaggcactttcgcttcagcaagcaatacgttcatatgacctggtaaacgtcctgcaaccgggtgaataccaaagcgaacattgacgccacgatcacgtagtttctgtgtgatttcagcaacaggatattgtgcttgtgccaccgccataccgtatcctggggtgatgatcacagagcttgcatttttaagtaattctgccacttcttctgcggtggtttcacggtgttcgccttgttcttcatctgagctgacttgaacatcgttaccaaagccgcctgcgataacgctgatgaacgagcggttcattgctttacacataatgtaagaaaggatcgcacctgaagaaccgactaatgcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttacgataagcaagtcattgcttaacataaagcctgctgcggcggctgcccaacctgaataagagttaagcatagaaacaaccactggcatatccgcaccgccgatagaagccactaagtgccaaccgaaagctaaagcgattgcagtcatcactaatacagggaaaatgttctcaggattatttaagaaggcaaccattaatagtgcagaaaccacaagtgccgcaaggtttaatttgtggcggtgtggcaacattaatgcttttgaattgataatgccgcgtaatttaccgaaagcaaccactgaacctgtgaaagtgaccgcaccgatgaagataccaaggaatacctcaacattgtggatattttgtagcactggatctgtttcgtgtgcaagaccgtagctgttaaagccgactaataccgccgctaaacctacgaagctgtgaagaattgccacaagctcaggcatttcggtcatttccacttttaatgcttgacgaataccgatagcaccaccgattgccattgcgattaaaatccaaatggttccttgtgattgtggtccaaagatggttgcgataagggcaatggtcatacccacaatgccgtaccaacaacctgcttttgccgtttcgtgtttagaaagccctgcaaggctcataataaagagaacggctgcgacaatatatgccgcttgtactaaacctaaagacatactctttctccttaaccttttctaaacattgctaacattctttgggtaactttgaagccaccaaagatgttgatactcgccactaaaatcgcaataaaggcaagcgcactgataaagaagctaccttgtgagatttgtagtaacgcaccgacaatgataatacctgaaattgcattggttactgccattaatggcgtatgtaatgcgtggctgacgttccaaactacatagtaacccactacgcaagagagaacgaagacggtgaagtgagataagaatgctgcaggtgcaacagaagctaaccacaagaatgcgatcaccgctaaggctaataagccatatttaatgcgaggatctgccggtttttcttcttttttctccgcaggttttgctgccgatttttgttgtggctgtgcagatacttgaattggtggtgctggccaagtgacttcgccatcacggattacggtaacgccacgcaatactacatcttcaaagtcgatattgatgttgccatctttctctttgcagagtaatttcaagagattgactaagttggtgccgtaaagttgagatgattgagttggtaaacgacctggtaaatcagtataaccgataatttttacttggttttctgtggtaaccactttacctgcttgggttaattcgcagttaccgcccgttgcagccgctaaatccacaatcaccgaacctggtttcattgtggcaaccatctctttggtaattaagcgtggggctggtttgcctgggataagtgcggtggtaataataatatccacttcttttgcttgttcagcatagagtgctaatgcacggcggttaaattcttccgacatcacttttgcatagccatcaccgctgccaccttcctctttaaaatcaatttcaaggaaacttgcacccattgattgtacttgttcttttacttcaggacgagagtcgaacgcacgcacgatggcaccaaggctgtttgctgcaccaattgcggctaaacctgcaacgcctgcaccgatcacaagtactttcgcaggtggcactttacctgcggcggtaatttgacctgtaaagaagctaccaaattcgtgagcggcttcaacaacggcacgataaccagcaatgttcgccatagaacttaaagcatctagggcttgcgcacgagaaatacgcggcacagcgtccatagctaacacattgattttctttgcagaaagtttttgcattaattcaggattttgagcaggccaaataaagctcacaagcgttgccccttccttgattaatgcaatttcggcatcggttggtgcattgactttaaaaataatgtctgcattccaaacggcttgtgcgttgccgatagtcgcacctgcttgagcgaaagcatcgtcttcaaaacttgctttaaagccagcattttcttcaatgatgacttcaaaaccaagtttcttaatctgttctacggtttttggcgttgctgccacacgagtttcaccgtctaacagctctcttggtacaccaataagcataaagactcctgtaggttggttaaaataataatgaattaaaacattgcaaatgtaccatttatttaactttttgggggatttttttcacgtttattttgaagaaatcttaaaatcatttaaccgattttttacaagcggaggatttcgtaataaaacttgcaaaagataaattattcgttggagttattaggacttttttgctatatttatgcccaattttttgccctaagtctatgggcttatttcgcttttaactaaatttaatggatcccttttatgtttaagaaatttctaggattattttcaaacgacctttcaattgaccttggtactgcaaacacgttaatttatgtaaaagggcagggtatcgtgcttgatgagccgtcagtagttgcggtacgtcaagatcgtgctggttcatcaaaaagtattgcagcagtaggtagtaatgcaaaatcaatgctaggtcgtacaccaaaaagcattttagctattcgtccgatgaaagatggggtgattgctgatttctatgtgacagaaaaaatgttacagcattttatcaaacaagtgcatagcaataactttatgcgtccaagtcctcgagtgttagtgtgtgtaccagcaggggcaactcaagtagagcgtaaggcaattaaagagtcggcgattggtgctggtgctcgtgaagtttatttaattgaagagcctatggctgcggcgattggtgcaggcttacctgtagcagaagctgctggttcaatggtaattgatattggcggtggtacaacagaagttgcggtactttcattaaacggtatcgttcattctgcttcggtgcgtattggtggtgataaattagatgaagcaatcatcgcttacgttcgccgtcactatggttctgcgattggtgaaacaactgcagagcgtatcaaaaaagagatagcaacagcttatattcaaaatcaagatgaaattcgcacaatggaagttcacggtcacaatcttgcagaaggtgcgcctcgtacattcgtgttaagctcaaaagaagtgttagaagcgattgaacaacctttaacaggcattgttgatgcagtaaaaggggttctagagcaatgtccaccagagttagctgccgatatttttgaacgtggaatggtattaacaggtggcggtgctttattacaaaatcttgatgtattactttcagaagcaacgggcgtacctgttatcgttgccgaagatccattaacttgtgtggctcgtggtggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagcacttgagatgatcgatatgcacggtggcgatctctttagtgacgacaactaattcaaccttgagttattagcataaaaatggacaatatcaacggctattgtccattttgcatttaacaagatccattaaatataactgaaatatgaaaccaatttttgcgaaagcaccacctatcggcgtaagactattctttgcaattgcgatctctatcagcctgattttacttgatggtagaagcagtgcaatgatccaaatgcgtaatgtcctcgaaacagcggtcagtggcttgtattattttgcaaatacccctcgcaccgtattagacggtgtaagtaacaactttatcgacagtcaaaaactgcaagttgaaaaccgagtattaaaagaacaactgcgtgaaaagaacgcagacttattgctactcgatcaactcaaagtggaaaaccaacgtttacgtttactactcagttcccctttacgccaagatgaatataaaaaagtagctgaagtgctgaccgcagaaatggacgcttaccgccaacaagtagtaataaatcagggacaaagtgacggtgcttttgttggtcagcccgtaattgatgaacgaggcgttgtggggcaagtgatttctgtcgggaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtagtcgagtattacttttaaccgatgtcactcacgccattcccgtacaaattttgcgtaacgatgttcgagcaatagccaatggcaacggacacagcaatgaattgattttggataacttaccaagaaccgtggatattggcaaaggtgatgtgcttgtcacctctggcttaggcggacgtttccctgaaggctatcccgttgccgtaattgaaaccgtacaaaatgatggttcaaaccattttgccagagcaacggctcggccattagcatcacttgatcgcctgcgttatttattactgttatggccaacaagcgaagaaatccgcaatgcatcaagcctttcaccgcaagatgtgcgtgatgctgtggaagaaagacgtaaaagtctaaacccattagaccgcttgaaaaatagtaaaaaagaacaagtaagtagtgatgaacaaaaagaagaaactgtcgaacctgaagaaactgtaaatccagcaacacagccagaagtcgataacggtattaatcacagcacagagcaaggggcagaataatgcgtgaaaatatgatctttcaaatgttagtgctgaccttcattttcgtcatcgcttttgtcctagagattatgccttggcctgtggatttacaaggattacgcccaacttgggttgtattagtgcttatctactgggtattagctctgcctgataaagttagtgtcggcaccgcttttttagcaggaattgtttgggatctgatcttaggctcaattttaggcattcacgcgttagtattgtcaattgcgatctattttgttgccaaatatcatcttatcttgcgtaatctctcgttatggttacagagcttacttgtgatggcatatatcacacttattcgtttctttatcttctttatcgaactagtgctacatagtgcagaatttaacacccaagaaatcatcggggcgatcataagcggcatcttatggccgtggattttcttactgatgcgacacatacgccgaggactacatttacgctaatgaacagcttatctttcgatttttctgcagattttcgtcccctttccgctcgaatgcgaccacgcactttagctgaatatgtcggacaatcacacctgatcggcgaaggcaaaccccttcgccgagccattgaagcaggacatagccactcaatgattttctggggtcccccaggaacaggcaaaaccactcttgctgaaattatcgcaaatgaacttgatgccgaagttgaacgtctatcagctgttactagcggtatcaaagagatccgagaagccatcgaaaaagccaaactcaaccgacaatctggcagacgcacgttactttttgttgatgaagttcaccgttttaacaaaagccaacaagatgcctttttaccccatattgaagacggcacccttatttttatcggtgcaaccactgaaaatccgtcctttgaactgaataacgccttgctgtcaagggcaaggatttacattctcaagccactacaagcggtcgatattctaaaaattttgcaaaatgccattgcagataaagagcgtgggctaggtaatgaaaaactcatcattcaagatgatgtgcttcaactgctggcggactacgtcaatggcgacggacgtttttctctcaactgccttgaattaatgtgcgatatggcagaacaattaccacaaggaaaattgctggataaagccttgctcaccgaagtgttgggcgaacgccaagcccgtttcgacaaaggtggcgaccgctattacgacctgatttctgcgttacacaaatccattcgaggatcttctcctgacggtgcattgtactggtatgctcgtattttaaccgctggaggcgatccactgtatgttgctcgccgactacttgcgatagcttcagaagatgtcggcaatgccgacccaagggcaatgcaagtcgcccttgcagcgtgggattgttataccagagtaggggcttacgaaggcgaacgggctatcgctcaagcggtgatttaccttgccgttgccccaaaaagtaatgccgtttacaccgcattcaaacaagccaaacgcctagctcaagaaggcaaggattacgacgttcccgaacatctgcgtaacgcaccgactaacttaatgaaatccttaggttacggcgaagaataccgctacgcccacgacgaacctaacgcctacgccgcaggggaaaactacttcccccctgaactgaaagacacccaattctacttcccaaccgaacgtggaatggaaaagcagatcaaagaaaaaatggcgtggttgaaagggttggatttgcagagtgaggtgcagaggtataacaaacaataagtttaaatttgtttgctcaactcaataaacaccctatgtttatcataactataaaagacgtggttactttgtgttttcgtaaaactataggttaaacgaggagtaatgccccataaatgcacggcacggtgccaaattgatgcattgaagccatattctttattacgttgaataatgttgaaaatcgttgctcccttatagcgtttttgagccacacttactgaaaggcgagtagaaaaccctctgccccattcttgcccccaacctaaactaattccccgacggaaaaagctatcatctttatcacgagtagcggtgcgattgtagtttaaatttgcaaaccaatattggtttgcattggctaaataaactaacccaccagagataaagtgataattgccattgaggtgcaagcgacttgcgtaacgttgttcggcatattcatagttagtgttgagttgccatttaggtgataaccaatagtttgtttcaagggttaaaccgcctgatttagaaaaacgtcttaatgtatcactttgattagagccacctgcataaagtgtttgctccataaatggtaacagcgtcaggttatattttgcattttgaaaacctagacctacactgccccgtaagctcatttcgttgtattttttattatcccaataatatttgccgttggtggcaagacgtagttcattaaagaagccatttccccacgaccattttttacctagatcgaagttaaaaccagcaccttctgccgattctcgttttggtgcgtgccagttgccgtaggttgttcctgcttttggtgcattattgatattaggatcgttaagataagtaagcccacctgaaaacgtccaacgatctcgccgatttatcgcattaatgtattgatcgataagttgggtaatttcagggataagcggttcagaacgcagttttttaaactgatcttctgaagcctctaattcgttattttcaaatagggctaccgcaagttgtaagcgaacaggctgaatatctgcttgttcggcaaggatctgacgatataacttgatcgcttccgtatattgctgatttttctttgccacaattgccgatgcccatttggtgagaattggatcgtgaaattgtgcaggaagctgttggtaaatgggataaagcaattcgacattgtcaatattaccttgcattaccgcaggcaataatgctcttatcactaaatctggatattttaccaactcttttgaagtcattgtaatactactcttatccgtttcctccttagcgatttgatgaaccttaaattgatggctgtgaatgaggatatcggctttttctgcttggactctattatcatttagatgttcagtaatactatcctgagatagttttgctatagagtagttagctaagactaataaaagtgttgcactaataaacgagtgattcataacgttcctataaaagcatgaagcaatgtcaagactgttgatttttattaacaataacttaactggcgcttacattgtttgaattaatgttgtaattgtcaaacttatcagatatcatattgataatgatttttatttgattactggatttattctaatatactcatatattatgttgcaatggttttataacaggttttataacatttcgatttttttatctgtaactcttgttcatatcgggttggcatatatgatttcacaactatcttgggatagagatctcaatcattttggggacttagaaaatttacaaatggttgaagtaaatttaggaagcgaagagcccattgaagtgaaaagtgaaagtgagccagaggtgacacaagagccagagcaaatactcagtacagaagtagcagatgtttcacaagcagatctcgttaaaaaagaggagaaacctgaagtaaaagtgaaaaaagagataaaaaaatccccagaaaagctcaccaaaaaagtagagaaaaagaaagtgttatcgcctaaagcacactcagatgaaaaaacaaacacaagccaagttgcccaaaatcatcaacaaggaaatcaaaatggtgttgaagggagtaagtctgtcactggaaacgccaaagtagatgcttctcttggtgcgggttatggcaatgcaatgcgagggcgttgttcagatatttctgatgaatctgatgatgtaggcagtgtgaaattaaaggtaacaataggaacgaatggtaaagcgacaaatgtagagattttatcttcttcgggtattaaacgtttggataatcaagcaagcagaatggcatcgggacacacctatcaaccagctaaagtaaataatagtgcagtcgtaggcagtgtgattttcagtattcattttaaatgtggggcagccgcctaaattatttgaggtaatttatgaatttaattcaacttcttcagcaacaagatattgtactttctatttcctttggaattttagtcgtgatgagtattttatcttggactattattttaatccgtctaattaaaatgatgggtgtaagaaaaaataaccaaaaaagttttcaattagtaaaatctgctgaaaatcttattcaagcagagcaatatattcaaaataagcggtctgaaattgcagatattttacagctgacttttaaacaatgtgaattatatcaagctaaagaaaagaaccatttatctcatcaacttccatttaaagatttcctgacattgcatttgcgaaatgccatcactcaatcgttgcgtaaatatgatggcggtttagttgcactcgcttctattggtgcagttgcgccgtttattggattatttggcacagtctggggaatttttaatgcacttatggatattagtcagcaagggcaagtcagtattgcaaccgtatctgcccctataggtgaggctttagttgcaacggcaatgggattatttgtcgccattcctgcggtgcttgcttataacttaattactcgccttaatcgtaatctttctcaagatttagatcattacgcaaacgagttatttatctatttattacatcactatggagaaaataaataatggcatttggaagttttgataaaaatgaaaattcggtaatgtcagaaattaatgtcacgccattagtagatgtaatgttggtgttattaattgtttttatgatcacaatgcctatattaacgcaatctatcccgcttgaattaccaaccgccaatgttgagaaaaaagatgaagcaaaagatattttcagggtggcgattaatcctacgggcatttatttaggcgaaaagctagtgaatgaagaagaattaaaacaatcatttctgacaaaatttcaggaaaataaaaataccgttattgctatttctgcggatatttccgtggaatatcaacatatcgttaaagtccttgaattagcccaaaacgttgggctaaccaaaattggctttataacccaaccaactaaataaatgcagtgtttttatatcggaggcaaatatgcattttaaacttaatccctatgcgttagcgtttacttctctgtttcttgtcgcttgttctggcggaaaaggaagttttgatttagaagatgtccaacctaataagacaacgggcgtgtctaaagaagagtatcaggatgtggaaacggataagaaagtaaaagaacagttaggggaattgatggaacctgctttggggtatgttgtaaaagttccggtgagttcttttgaaaataagaaagttgatatttcagatatagaagtgattacgaacggaaatttggatgatgtgccatatcaagcaaattcttctaaatatagctatccagatgtaaaaacaaaagattcttctcttcagtacgttcgctcaggatatgttattgatggggaacactctggttttaatgaaaagggatatgtgtattataaaggtaattcacctgcaaaagaattacccgttaatcagcctttaacttataaaggaagttgggattttacttccaatgcgaatttaaataatgaagagggaagacctaattatttaaacgatgattattatactaactttataggtaaacgggcagggttggtttcaggagatgcgaaaccttcaaagcataaatacactagccagtttgaagttgattttgcaactaaaaaaatgacaggtaagttatccgataaagagaaaacgatttatacagtcaatgctgatattagaggcaatcgttttacgggttctgctacagcaagtgataaaaacaaagggaaaggtgaatcatataacttctttagtgtcgattctcagtctttagaaggtggtttctatggtccaaaagcggaagaaatggccggtaaatttgtagccaacgacaaatctctttttgccgttttttcagcaaaacacaatggctctaatgttgacaccgttcgtattattgatgcctcaaaaattgatttaactcattttaattcttcagaacttaccaattttggcgatgcttccgttttaattattgatgggaaaaaaatggatctggcaggtagcgagtttaaaaataagcacattgttgaaatcaacggtaaaacaatggtagcagtagcttgctgtagtaatttggaatatatgaaatttggtcaattatggcaaaaagagggtgaaacagccaaagataatagtttattcctacaaggtgaacgtactacaacggataagatgccaaaaggcggaaactataaatatattggtacttgggatgcactcgtatctaaagggacgaactggatagcggaagcggataataatcgagaatcgggctatcgctcagaatttgatgttaattttggtgataaaaaagtaagcggcaagttatttgataaaggcggtgtaaatcctgtgtttaccgtagatgcaaaaattaatggtaatggttttaccggaaaagctaaaacctcagatactggcttcgctctagactcaggcagttcacgttatgacaatgtgaaatttagcgatgtagcagttaatggtggcttctatggtccaacggcagcagagcttggcggacaattcttccataaatcagacaatggcagtgtaggtgctgtctttggtgcaaaacaacaagtaaaaaaataataaggaatttgctatgaaaaataaattaaatcttattagccttgctcttcttagcctctttgccgcacaaagctatgcagaacaagcggtacaattgaacgatgtttatgtcacaggtaccaaaaagaaagtgcataaaaaagagaacgaagtgacaggcttagggaaagtggtgaaaacgccagactcactcagtaaagatcaagtgttagggatgcgagatctgactcgctacgatccaggtatttctgtggtagaacagggacgaggtgcaacgacaggctactcaattcgtggggtagatcgtaatcgtgtgggcttggcattagacggcttgccacagattcaatcctatgtaagtcaatattcacgttcctcaagcggtgctattaatgaaatagaatacgaaaatctgcgttcgatccaaattagtaaaggggctagttcttctgagtttggtagtggctcgctaggcggttcggtgcaattccgtaccaaagaggtaagcgacattattaagccagggcaatcttggggattagataccaaaagtgcttacagtagtaaaaatcagcaatggctaaactcacttgcttttgcgggtactcacaatggctttgatgctcttgtgatttacactcaccgtgatggtaaggaaacgaaagctcataaggatgcggaaagtcgttctaagcgtattcaaagagtggatctcgcagacaataatcctcaagatagcaattggtttaaagttaagaatgattgtccaagtttgaactgcgaaccacgtcagcaggctaaagtgtcttatgatgggcaaaagtatctaacagagcaacttagtgctaaagaatatacaggtgaagaacgagctttgcctgatccagtgaaatataaatctgattcttggttggttaaattaggttatagcctttcaccaaaacattatgtggctggtgtttatgaacatagcaagcaacgctatgatactcgcgatatgacctatcctgcttattggcagctatcagatttaaaaaatggtaatacgtggtatccaatgaataatgctaaagggttatatcgtagtaatgctttagatggtgttgctattgattactttacagaagatggtgtgaaatcctcaaaaggattacgttgggcaaaagctcgttttattgatgagtggcacactcgtgatcgcttaggtgctttatatcgctataccaatcaagataaagatcgtctgattgatagcctctctttgagtttcgatcagcaaaaaattgatttatctacccgcttgagagagaacaactgttccgaatatccaaccatagataagaactgccgtgcaactcttgataaactttggtcctcaactaaaaatgagcaaagttcttatgaagaaaaacacgacactattcagctctcgttagataaaaccgtacaaacgggattgggcaaacatcaattaaatatgttattaggttcagaccgtttcaattccaccttaaaacgccacgaaattttgagtaagttttctgtgggaacttggcatcgtatcagtggtaacggtcataaaaatacaccttacatctatgagctaaaagatcaggcaatttatagtaaaaatgaatgtaattatagtggcactattgcaggcagggctgattgtgctacaagcaaaatcaaaggacataatcactacatcgctctgcgagataattttgccataaccaaatatttggatattggtttaggctaccgtttcgataagcataaattccgcagtactcaccgctgggcaaatcaaggcgattataaaaacagtgcgtggaatgtcggcgtagtcgctaagccaacttcattcctatcactctcttatcgagcatcatcaggctttagagtgccaagtttccaagagctatttggcttacgctatgatggtgcaatggcaggttcgagcgatgcttaccaaaaaacagagaagttatctcctgagaaatccttaaaccaagagattgcagcaacactcaaaggtgattttggtatcgttgaagtcagttatttcaaaaatgactataaacagttgattgccccagcagaaaaaatgcaccaaactcaatcaatgattaactattttaatgtgcaagatattaaattagacggtattaatctgattggtaagttagattggaatggggtatttgataagattccagagggcatttatacaacattggcatatagcaaaatgcgagtgaaagaggtgaaaaattatcctgggtatatgaacattcgcaccccattgttagacaccattcagcctgctcgctatgtcgtagggatcggttacgatcaaccagatgaaaaatggggcgtgaatctaacaatgactcattccagcggaaaaaatccagatgagttaagaggtaatgaacaagtcggttttgccaattatgaacgaactgctacgaaaaaaagaacacgctcttggcatacctttgacttaacaggatatgtcaccccttggaaacatgtaacggtacgagcgggtgtatataatctgatgaattaccgttacaccacttgggaatccgtacgtcaatcttcgcttaatgcgattcatcagcatactaatgtgaaagattacgtaagatatgccgcacctggtagaaactatgtcctttcagtagagatgaagttctaactttctatagagcatggaataaatttgtgtaaatacctgtttctgtgataatacatctagatacaggtatttttataggtgagcaggaattcggcacattatacgacaagtgttattgaatctctaggtgatgtaatccgtcgagtaattaaggaaagaaacgtatttccaattgatgatgtgacattttaaatagcatagtttttggcagatcagcaaacaaatttgcctacttgccgcaattaatgaggtggcaaaaatgaagcatgctaactctaaactagaaacagccagcttattgattttggtgatcgcctaagcgaccaccataagtttaaaatgaagatacttagaattagagatagatgtacaaataacagcgcttggatatgttatctcagatacaaatatttacgccatctataatgcttcattcgcttttttaatactatcatctgctctgcgtgcttcacctttatgtttttgtttatttaactgggtttcaagttttgattctacttcgttgatagctttatagagatcttcatcatgtgcttttgcaaataaatcgccaacaggggttccaatagaagcctcaacttcgtaaccatttggtaatttgtggataataaagtgagggttaattaactgagtttgccatttattcagtttagccaaacgctcctcaatgtgcgtacgaattgcaggggtcacttccatttgtttgcttgaaatattgattgtcatagcatgtacctcttttattatgaccttgttggtcgttgaatggatgacttcaaattatgcctttccccctaaaatttcaacccctaaagttaaacaattttcaaaaacttgatctacttaacacttttctggtttttttgactataattccaacgatatttgtgagaggtatttatgttatcagaaactcgcttggcaaaaattcatgaaatggaacagattttaaatgaagcaaatagcctaatgaataaaatggaacagcttcaacagtcgtggatagttcttttaccaaaaatccgagagctagaaaattattatgctgaacagtggcaagaagattataatgctgatgaacgaggggaaattccctcagagatgattcgaggcgtattaagtgaagatgccgtgtataatttattcattgctcatcgagaaatcgcactggagtggattcgcttgtcagtgaaatcaatggaaacaacataatgatagataaaccacttcctccttttcagcgagcctttttacatccaaagtattggggtttatggctaggattgggaattttcaaactgattttatgcttaccttaccctattttagcgaaagtcggtaagggcttaggtaaactgtttacccgattaggtttggataaacgccgtatgcgaattgccaaacggaatttggaactttgcttcccagattataccgcttgtcaaattgatgaaattttagctcaaaatgccgaatctgtcggaatggcaattattgaaacagggatggcgtggttttggtcagatgaacgtattcttaaatggtcgaaaatagaaggattggaacatctgaaaaatcagcctgagggttcggggattatttttgtcggtgttcattttctgacccttgaacttggggcaagaattgtcgggcttcatcatcaagggattggcgtatatcgtccgaatgataatccgctgttagattggattcaatttcgtgggcgagtacgttctaacaaagccatgctagatcgcaaagatttacgcggtatgattaaagctcttcgtgcaggggaaaccatttggtatgctcccgatcacgattacggacgcaaaaacagtgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgtgccgttttttgcggtgaaagaagcgtgtacaacagctggaacgagaatgttattacgttccgccccaaatagtatcgttgtgccatttaccccaatgcgaaacgacgatttttcaggttataccgtcaaaatcaggcctgcagtagattttagccagtgcaaaaatgacgttgatactgcaaccttaatgaacaaggtcgtagaaagcgagattatgcaagctcagagccaatatatgtggctacatcgtcgttttaaaacccgaccgaatgagagcgatccgagtttgtattaaaccgccgacattaaacctagtagggacgccacgcttggcgtcctagaaaacaatttttaaggtagcaactgtgtttgtgaatgctcatagtttcagaaatttcaatatgacgaaagagatagtgaacaaaaccaaaattgtccttgccacaggcaatcaaggaaaagtgaaagaaatggctgatgtgttagctgaatttggctttgacgtgattgcccaaagtgaatttgacattcaaagcccagaggaaacaggcttaacctttgtagaaaatgcattgattaaagcccgttatgcctcacaaatgacaggtttaccggcgattgccgatgactctggtttagcggttgaagcattgggtggtgaaccggggctttattctgctcgttatgcaggtgaagaaggaaacgatcaagccaatcgccaaaaattattggctgaaatggcaaatgttgccgatgaagatcgcacggcaaaatttgtcagttgcattgtgatgttacagcacccgaccgatcctactccaaaaattgccataggcgaatgttacggacaaattttacgtgaggaacgtggttcaaacggttttggctacgatccactattcttctatccgcctaaaaactgcacctttgcagaacttgaaactgttgagaagaaaaaaatctcccatagagcgattgcattacaatccctgaaacagcaattgaaataggaacattatgattattaccacaactccaaatattgaaaatcatcaaatcgttgagtacaaaggcttagtctttggtgaagtcgtgtcagatgcaaatgccgttgtcggggtgtctatggaatatcagtctatgggcggtgataaaggaatgtttattgtggttgcgaccggcacagcggttgttattcgctaatgttgcaaaaaaatcttcaaatcacaccgcttttttggcaaactaaaacactgcttgaaatgaatgaagcagagtgggaagccctgtgcgacggctgtggtaagtgttgctaccgcaaatatattcaaggcagaggcaagcgggaacggctgtattacacctctgttgcctgtaatttgcttgatgtgaatacaggtcggtgtagcaactatgcggagcgttgcaaaatcgaaaaagattgtaccaagctcaccaaaaagaacctatccgattttggctggttgccgaaaacctgtgcctatcgactgatttatgaaggcaagccgttgtttgattggcacccactgatttcacaagatcctaattcagtgaaaagagcaggggtgttaatccccaacggcattcacgaaaaagatgtgattgattggtttgagtttgtgattgatactgtataaatctcaatatggttagtattctttatgagtaatttaaattacttttaaagttctaacaaatacgccttcaactgatgaatcttatccctcaccgcagccgctttttcaaactcaagatctttagcaaaatctctcatctgttgttcaagcactttcagttctttttctaactctttgcgagatttcggcgtgtaagcggtctgatcatcgcttgattttgcagatttcttactgcgtttcggtttatccgtctgcccaatatcaagcaactcgccgacttttttgttcaatgcttgtggcacaatgccgtgttcttcgttgtatttttgttgtttctctcgacggcgttcagtttcggtgatcgctttttgcattgaattggtaatacggtcgccgtataaaatcgctttgccgttgaggtttcgggcagcacgcccgatggtttggattaaagagcgttcggaacgcaaaaagccttctttgtcagcgtctaaaatcgccaccagcgacacttccggcatatccaaaccttctcgcagtaggttgatccccactaacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccccactaacacatcaaacattcccattcgcaaatcgtggataatttcaacccgctcgactgtgtcaatatcgctatgtagataacgcactcgtacgccgtgttcgtctaggtagtccgttaaatcttccgccattttttttgtcagcgtggtgactagcactcgttcatctaccgccacacgcttatgaatttctgacaataaatcatcaacttgcgttgccacagggcgaacttcgataatcggatctaacaagccagtcggacgaaccacttggtcgattacatcaggatttttctctaattcgtaaggtccaggggttgccgatacatagattgtctgtggcgataagcgttcaaactcttcaaaacgcaacggacggttgtctaaagcagatggcaaacggaaaccgtattgcaccaaagtttcttttcttgctcggtcgcccctaaacataccgccgatttgtggcacggtaacgtgggactcatcaataatcagcaagccatcagacggcatataatcaaacaaggtcggtggcggttcaccctcttttctgcccgataaataacgtgagtagttttcaatgcctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctgagcagtagcccaactcgttcatcatctcaatatcaaactgagtacgctgggcgatccgctgttcttcgagtaatttattctctttgataaagtaagttcgacgctcggcaagttcttttttgatctgctcaatcgcttctaaaatccgatctctcggcgtaacgtagtgggttttcgggtagattgtataacggggaacacgccctaaactatgtcctgtaagcggatcgaataaagaaaggttttcgatttcatcatcaaacagctccacacgcagagcaacatcgtccgattcggcagggaaaatatcaatcacttcgccacgcacacggaaagtcgcacgctgaaaggcttgatcgttgcgggtatattgcaattcagcaaggcgagagagaattttgcgttggtcgatcatctcgcctacctgcaaattaaattactcgaagaacagcggatcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtcgatcatctcgcctacctgcaaatgcaacatcatctgcatataggcattaacatcgcccaaaccgtaaattgccgacactgaggcgactacaatcgtatcccgtctttctaaaaaagatttggtggcagacagtcgcatctgttcgatctgctcattgatagacgcatctttttcaataaaagtatcgctggcaggcacataggcttcaggctgatagtagtcgtagtaggaaacgaaatactccaccgcattttcagggaaaaaggctttcatctcggcataaagttgtgccgcaagggttttgttcggggcaagcaccattgctggacggtttaaagtcgcaatcacattggcaatggtaaaggttttgcccgatcctgttacacctagcaaggtttgatgtgccaagccatcattcaatccctcgactaatttggcaatcgcagtcggttggtcgcctgagggtttgaagggggaatgtaaaataaatggtttaccctgtttgctcattgaaaatccttgtctgaaaatttgctagaattctaacatagaataagtggtgagattttgggaatttcagcctaaaaagaaattttgttattcatacaatttactttaaaaatcctctttggtggacgctcagaaatccattacaattcttcgtaaaataatgctaaaactcaccgctatgattaatacacaaactttaaaaacagaacttcagcaatttaatagcacacaaaaatccctttttagtactgaagatatcaaaaatttactcgaacaacgtagccatttttatgatgatttactgacaacgctctggcaacaatttgggttgatggagcggcaggacttggctttagtggcagtcgggggatatgggcggagggagatgtttccgctgtctgatttggatattttggtgttgagtgaacagcctttagatgaacagacgcaaaatcaattaaatcaactatttaacctcttgtgggattgcaaatttcagctgggggcgagtgtgcgaaccttggcggagtgtgttgaggtgggcagagcggaaatttctgtggcaacgaatatgtttgagagccgttttttgcttggcaatgaagccttgtggcaacagctgatgagcaagctgttccacgcggagttttggtctattcaagccttttttgaagcaaaaatggcggaaaaaaatgaacgttatgcccgttatcataataccagttataaccttgagcctgatttaaaacatagtccgggggggctacgggatttgcatttgctctcttggattatgttacgccattatgggctatatagcctagagagtttgtttagtcggggtttgctctatcctgaagaatttattgagcttcagcaggctcaacatacgttatttagaatgcggtttgccttgcatttgcaattaaagcgttacgataaccgcttgcggtttgatcgccagttacaactgagtgagcagttaggctatcagggcgagggtaatcagcctgtggaagcgatgatgaaagatttctttcaggcgacgcaatctatttcgcaattaacgcaattgttgctcaatcattttcatcaagaggtgctacaggctttgcaaaatgtacagcaaaaacagccgcttgatgactatttttatttgcaaggggaacagctaatttgtagtaacactttgatttttaagcaacaacctgagcggattttggatcttttcttctatctcactcagcatacgcaggtgcgtgtagccagtacgacgttgcgacaacttcggctggcgttacagaccttaaaccagccgttgtgtgaactgcctcaagctcgacatcgctttattcggctgttttctcagcctgatgtggttaaaagagccattatgccaatgcatcagttgggcgttttaaccgcttacttaccgcaatgggttggtattcaaggcttgatgcagtttgatctttttcatatttatacggtggacgagcatacggttcaggtgatgcttaaattagaaagttttctgcaacaggaaaatgccgaaaaacatccgctttgttgtcgtctgtttccgacactggcagaccgtccgttgctctatttgtcagccttgttccacgatattgctaaaggcagagagggcgatcacgctaaagttggggcggaagatatgcgtgcttttgctcaacaacacggcttttctcaagagcaaagtgattatatggcgtggttggtggcagagcatttgacgatgtcaattacggcacaacgtcgggatattcacgatcccgatgtggtgaaaacttttgcaaatgtggtgaaaaatccgaccgctttagctgctttaacctgtttaaccgttgcggatatttgtgcgacgaatgaaaccctttggaatgattggaagcggtcgcttttccttaaactttttcaatttaccgaacagcagttgcagttaggcagtgaggaaacgattaatcatcagcaactgagccaagcccatcaacagcaagcctatgtacaacttgaggcgttactttcggctgaacaaaaaacacggctgttgcaattttggcaatcctgtcctgaaagctattttgtgcgaaacagcccgacacagctttattggcacgccttgcattatttaaaagatcctgcgttgccgatggtgttgattagcaatcagtatgcacggggagcgacagaaatttttgtgcattgccaagaccaagcccagctttttgcgagaattgcacagacgttaagtcagaagaaagtgagtatccacgatgctcaaatccttacgagcgatcatggtttggtgttggatagttttattattacggaaatgaacggtgagccactcgatgatgagcgaagtgaacaaattcagtcggcattggttaaaaccttgcttgcgaatacggagaaagtgtttaatccaagtaaaaaatccgttaaacatcaggcgtttaagcgaaaaaccaagatccgttttttagcaaattcccagccaaatcagaccgcttttgagctatttaccttagaccgagaggggttgttggctcaaattgggtatattttcgggcagcttaagttgaatttgattaacgctaaaattacgaccattggtgaacgggtggaggatttttttgtggtgagcaatcagcaaaatggggctttggcggaggaagaacaggcgatgttgaaacaacatttgttggcgatgttagaacaagaatagaatgctatactgtctatcaaacaatgaattaagagtaaaagatgttattgttatattcagtattagtaaaaaggtaataaagaatgctactcgcacaagaccccgaacagtttcgagaatctgcgtatttacgccaattttggatagagttgaggaaagacacctttgcactcatcagccttaatctctttattcttctgatgggattggttttttttggctatttacttgccccttatgcagccgatcggcaatttagcggaatggaattaatgccaccatcgtggagtgatagcggtcagattagccatttttttggcacagacgatctaggaagagatattttcagtcgcgtcctctacggcttctactataccgttggctcagcattggtcattactattgctatcggtattttaggtggcattcttggcgtgattgcagggacaaaacggagtggatctatttttattctcagtcatctttttgatacctttttatttacgccgattttgctgattgccatcatcattgcaactttaatggaggcctcgctcattaatgcaatgttggccatttttcttgctatgttgcctcactttatccataaaatttatcaaacgacccaacgggagctggcggagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggcgagagaatatgtcatcactttaaaattagagggtgcaagaaaacgagatttaatccgtgaagtgatcttacctaatttaactgtgattgccgtcaaagaacttgcgcatatttttgttattgccgtgttagacatcagtgcattgagctttatttcactgggggcaacgagcccaacgccagaatggggagcgatgatccgcgattctcttgaattaatttatgttgccccttggacggtcattcttcctggatttgctatcatttttactctacttatcattacaatgcttggaaacagcattgtacgggtgcttgaaaaatatcgttattagggaagggaaacaatggcattactggatattagacatttaagtatcgaaattgacacgccaaacgggcgtataaaaatggtagacaatatcaatcttacccttgatagcggtgagatatgtggtttagttggcgaatcagggtcaggaaaaagtttaattgctaaagtgatctgcggattagtcaaagacgagtggatcattactgccgaccgctttcgctttaacgatattgaattactgaaactttccccctatcagcgtcgaaaactggttggtgatcagatttcaatgattttccaagatccactctcttgcttagacccaagcgaacgtattggtaaacaattaatcgaaacaatccgctttaaaggcaagtggtgggaacgttttggttggaaaaagaaaaaagccattgaattgctgcataaagtgggaataaaagatcataaagacattatgcaaagctatccaacggacattaccgaaggtgaagcacagaaagtgatgattgcaatggcggtggcaaatcagcctcgcttgctcgtggctgacgaaccaaccaatacaatggaatcaactacacagctacaaatttatcgcttgctttccagtatgaacaaaaatcttggtacgtctattattctagtgagtaacgatatgctcagtatttacaagtgggtagattcatttaacgttttgtactgcgggcaaaccgttgaaattgcagagaaagaaaccattatggaaaccccttatcacccttataccgcagtactattgcatagcgtacccgatttttctaaacctttgccttttaaaggtcgcttgaatacccttaaaggctcagttccaatgttacaagatatgcctattggttgccgtcttgggcctcgttgcccttttgcgcagaaaaaatgtgtcgttaaaccaccgctacgcaaattccgccaacacgaatttgcctgccattttccgattaactttagagaacaaaatttcttacgtaaggaagaatttgtgccagtgatcgtaaaagtagattagatgttatatagcttagtccatattaatgatgatagaaaaaagtctatatcggtatttaatactcgaatatataattggtcttaatttagaaaaatcccttttcgatcaaatatcctttaaatttttgtgaagctcatcacttttttacaagacaaatttgtaaaatcccattaccatatacaagtcttttcaacattaactattaactctcatagaggatattaacaatggcaaaaatcgttaaagtaattggtcgtgaaatcattgactcacgtggtaacccaactgttgaagcagaagttcaccttgaaggtggttttgttggtttagcagcagcgccatcaggtgcatcaacaggttcacgcgaagcattagaattgcgtgatggcgacaaagcacgtttcttaggcaaaggtgtattaaaagctgtttctgcagtaaacaacgaaattgctaatgcaatcgtaggtaaagatgcatctaaccaagctgaaatcgaccaaattatgatcgacttagatggtacagataacaaatctaaatttggtgcaaacgcaattttagcggtttctttagcaaacgcaaaagcggctgcagcatcaaaaggtttaccactttatgctcacattgcagagcttaacggtactccaggcgtgtactctatgccattaccaatgatgaacatcatcaacggtggtgagcacgcagacaacaacgttgatatccaagagtttatgatccaaccagtgggtgcatcaacattaaaagaagcacttcgtatcggtgctgaagtattccacaaccttgctaaagtattaaaagcgaaaggcttaaatactgctgtgggtgacgagggtggtttcgcaccaaaccttgcttctaacgcagatgcattagcttgtatcaaagaagcagtagaaaaagcaggttatgttttaggtaaagatgtaactttagcgatggactgtgcgtcttctgagttctacaacaaagacaacggtttatacgaaatgaaaggtgaaggtaaatcattcacttctcaagaatttactcactacttagaaggcttatgcaaagagtacccaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttccgatctagaaggcttatgcaaagagtacccaatcgtgtctatcgaagatggtcaagatgagtcagactgggaaggttttgcgtaccaaactaaagtattaggtgacaaagttcaattagtaggtgacgacttattcgtaaccaatactaagatcttaagccgtggtatcgaaaatggtatcgcaaactcaatcttaatcaaattcaaccaaatcggttcattaactgaaactttagcagcaatcaaaatggctaaagatgcaggttacacagcggttatctcacaccgttctggcgaaactgaagatgcaactatcgctgatttagcggtgggtacagcagcaggtcaaatcaaaacgggttcaatgagccgttcagaccgtgttgcgaaatacaaccaattaatccgtatcgaagaagcattggcagcagcaggtacaccagcacctttcaatggtcgtaaagaagtgaaaggtcaagcgtaatttgcgttgatttattgaatatagccaccttgagaaattgaggtggcttttattagctatgtcccataaaacttaccctttcgggcggagatataaggtacaaatagcgtaagttatttcaatcttgttaagtttgtgattacttgataataagtgttcagcagaaagagctcaccgagggtagcctataacaatcaatcggagctagttggagccttcgtctttaaagacttggacgtcaacaattcttcaatctaataaaatacatcaagaaatcttataagaattaatttcatagtttgtggaatgctatggtagaattgcgaaaaaactctgatttgatttcatagaaggagaataagatgccatcttttgatattgtttctgaacttaccatacatgaagtacgcaatgcagtagaaaatgcaaatagggtattaagtacacgttatgattttcgaggagttgatgccacaatagaacttaatgaaaaaaatgaacttatacgggttactacagaatctgattttcaacttgaacagttaattgaaattttaataggatgctgtattaaacgtggtattcaacatacttccctagatattccttctgaaagtgaacatcatggtaaactttacacaaaagaaattaaattaaaacaagggattaagtccgatatggctaagcagcttgttaaacttattaaagactctaaaatcaaggtacaagctcaaattcaaggagattccatacgcataacaggaaaatcccgtgatgatttacaatcgacaatacagcttgtgaaaaatgctgaattagggcagcctcttcaatttaataattttcgtgattgattttccatatatatcttctttcatttaatcaatataaagaatcttttcattgaatctaatcgctcaaacttactagagtgatttctctgttttcctataggctgtaaagagatacttatgtcagaaaaacgctacggtgctgatgaaattaccgttctcaaagatcttgaacctgtgcaacttcgcccaggtatgtacactgataccactcgtccaaatcacttagggcaagaagtaattgataacagtgtcgatgaagcgttatcaggttttgctaatcaaattgatgttatcttacatagcgataattcccttgaagtcgttgataatggacggggtatgcctgtggatattcactcgactgaaaaaatttcaggggtggaacttatcctaacaaaactgcacgcaggcggtaagttctctaataaaaattacaccttttcaggcggtttgcacggtgtagggatttcggttgtaaatgccctttctgaaagtgttgagatcaccattaaacgtaatggcgagatttataccattgcttttgcaaatggcgttaaagtggaagagctgaaagtgatcggttcttgtccaaaacgccaaacaggcacaacggttcgcttttatccaaatccaaaatattttgattcgccgaagttttcggttagtcgcctacgtcatctattgcgagccaaagcggtactttgtccgaaattaacgatcaattttaccgaccatatcaataatacccaagaaacgtggtactacgaagatggcttgcgtgattatttaacagatgcattgaaagaatatgaatatctgccaaatcctctttttgttggtgaagtgattggggaaactgaagctgtgagttgggcattaagctggctcacagagggtggcgagcagattaatgaaagctatgtaaacttgattccaactgcacttggcggcacacacgtcaatggtttgcgccaaggtttatttaaggcaatggctgaattttgtgattttagaaatctgttgcctaaaggtgtcaaattaactgccgacgatgtttgggggcgttgttgctatgtgctatcacttaaaatgcaagaaccacagtttgcagggcaaaccaaagagcgtttatcatcacgacaagcggcgagttatgttgaaaatagtgtaaaagatgcttttagtttatggctaaatcaaaacgtacaggttgctgaacaactggctgaaatggcaatcagttctgcacaaaatcgccttagagccgaaaaaaaagtcgtacgaaaaaaattggttagtggccctgccttacctggaaaattggcagattgtatttcacaagatttaacgcgtactgagctattccttgtagagggagattctgcgggcggttctgcaaaacaagcgagagataaagagtttcaagcgattttgccgcttagaggtaagattctcaacacttgggaagtatcacctgatcaagttctcgcgtctacagaagtgcacgacattgctgtcgcattgggcattgatcctgacaatgaagatataagccaactacgttacggtaaagtttgtattcttgctgatgcggattcagatggtttgcacattgccacattattgtgtgctttgttcctccgccatttcccaacattagtaaaaaatggccacgtttatgttgcaatgccgccactttaccgtattgatattggtaaagatgaggtgcattacgcattagatgaatctgaaaaagaggctattttagctcgtcttgcaaagaaaaaaggaaaaccaaatgttcaacgctttaaaggtttaggtgagatgaacccaagtcaattgcgtgaaacgacaatggatccaaatacacgacgtctagttcagctaaccttagaagataatagcgatgatgaagaggtttcaacctttgaattaatggatatgttgcttgctaaaaaacgggctgaagatcgcaaacaatggttacaagatcgtggtgatgaggcggatttataaataaaccaaataaagattggcgttgaaaattaatagtatttttttattaattcaatagttttacaaacttataactatcaatgataatactcgtaacctattaataagctatttttggaggaaattcactatgtataaatgtccatttgatcacggatcaaaaaccttaacaacggcagcaggtgcgccagttgttgataatgacaacacaatgtcagctggcccacgcggtccacttcttttacaagatgtttggtttcaagagaaattagcacactttgctcgtgagcgtattcctgagcgtgtggttcacgctaaaggttcagcagcttacggtacatttactgtaactgcagatattactaaatacacgaaagctgcggtatttaaaccaggtgcacaaactgaagtactattacgtttctcaactgttgctggcgagcgtggggctgccgatgcagagcgtgatgtgcgtggtttctcattaaaattctataccgaacaaggtaactgggacttagtgggtaacaatacaccagtattctttatccgtgatccattaaaattcccagattttattcatacacaaaaacgtaaccctcaaaataacttgcgtgatgcaaatgcagcgtgggatttctggtcacgtcaccctgaatcaatgcaccaaattatgacattgttctcagatcgtggtattccagcgactttacgtcacatgaacggttacggtagccacacttatagctttgtaaacgcaaacaacgagcgtttctgggtgaaattccacttcaaaacacaacaaggtcacaaattcttcactaacgaagaagcagctaaagttgtaggtgaagatcgtgagtctagccaaaaagatttatatgaagcgattgagcgtggtgaattcccacgttggactgttcaagtgcagattatgccagaagcagatgctcacaaacataactatgcctttgacttaactaaagtatggccacacgcagattacccagtgatcgaagtgggtgtattagaattaaaccgcaacccacaaaactacttcgcagaagtagaacaagcggcatttgcaccatctaacatcgttccgggaatcggcttctcgccagaccgtatgttacaaggtcgtctgttctcttaccaagatgcacagcgttaccgtttaggtgtaaaccaccaccaaatccctgtaaatgcaccaaaatgcccataccacacgactcaccgtgatggtgcaatgcgtgtagatgcaaacggtggcaaccaccctaactatgcaccgaaccgttttgacacttatgtgccaacccacgatcaattaccattacaaattgagcgtgaagccgcacactttaacttccgtgagtacgatgaagattactactcacaaccagccgcactttacaacttgttcacagcggaagaaaaagatcgcttagcaggtaactttgcagcaggtttatcaggtgtaactattcctgaaatcgtggaaagacaaatggctcactttgaaaaagttagcctagaattagcaaatgcgattcgtcaaaaattagcaaaataagctaattaaagacttattttctccttacacttgtatttgctatactttaagcccaaccgttttggttgggctttttttcttggaaagaataaatatggaataccgctattacattatcacaaccgtttcagttatcgcccttcaatttctgctcttttgcttttctaaaacagcaacttggttaggcgatctatcaaatagaagtcgtaagatcgttacattttctatctatatcgttgcaaatctgttgataatattgcacgttacacgcattttgccaaacttccgcttaattgctttaatactcacattacttttatttatcttcttcatcagcttctgtttttgggggatttatactgtcggcaaacagatattctcgccgaatagccttaatcgctggcttaaaataagctatatccctgttttattcgggttaattgggctgactatttacaacgcctattcaaccaaagtggtgcattatcaagtcacattagataaacctatacagccacttaaaattggcgtcgccagcgatttccacttagggaaatttttcggggggaaacagctagataagttagcaaccatctttaatcaagaacaagttgatctaattttgctccctggcgacattatggacgataatgttgaagcctatttggcggaaaatatgcaaccgcatttggcaaagttaaaagcaccgcttggggtatatgctacaatgggaaaccacgatttttttggggctgaagctgaaatttatcaagaaatcactaaagctggcattactgtgctatgggatcaagcggttactttagacggaaaatttacgatcatcggtcgtaatgatgaattagtgaaaaatcgccctgaaacagcagagttattggctctggtagataaaaatttacccgttttcctaatggatcaccgcccaacacaaattgagcaacatgctcaactgcctattgatattcaagtgtcgggccatacccataatgggcaaattttcccagcgaatatcattactcactttatttaccgacttgctcacggttatgaaaaaatcggtaatggacatttttttgttacttcgggatacggattttgggggataccgatgcgactaggttcacagtcggaagtgatgattattgaggtgaaagggaagtaattacacaaagcacaattcaaggctactttttagggaccattttgcctgttactccctatgttttaaatgacgctatcccaacaacgccttcaaatttgctttcatcttatccacttgctctgcataaatctgtttcttctctaattcatcgatcaaataatgaatggtttcagacaaggtcagatccatttctttggcttgcttggacaggcgttgccagctggcgtattctaaatcgatagattttttacgggtagattgcttttcggcattgaaaaaacgcttgcgtcttgctcgaatagattgacgcattttcttgcgttgctcagatgtcatttccgccttaatccattgctcgatctcttcgggcgagttttgtaaggtggttaataattgaactttcaattcgatcaagctctgttcgtcgtatttggtgatattttcgccttcacgatattttttcagcaagtatttccatttccaacttgcttcttgaatttcaagtttttggtatcgcattttgcctccgaattatttgtgaagtatagcgtaattataggtataatgaagcaaatttctataaagaggcaaatttgtgcaagtatctccattatcgttgcaatcattaagcgttcactatcctttcaaacagaccgatcaagcggtgagatttttggattttcaaccaaatacacagcaggcaatgcaacaatttgccctgagtgaatttggttcggcactcattttgaaaacggaattatttcccgaatttttaaatgaaatcacggactattttgaaaatttgcattgtcaaactgtgttgaaaacagaatttaatcaccaaagtttatttggatatagcctttatttagaaaaggaaaaccaaattaaaacggtggcaggggcaattgagcaagctcataagggtattctgattttaaatgtgagtgcattattattagatattgtgcaatgggataaattaaaacaagctcttttatttgggcagtttgacccgattattgcgggaaaattacctgaagcaattatgcctattcaatctcaattcaaattgatattagtgggtagtcgagatgatattgcgactttgcataattatgatgaagatttatatcaattttgccaatatgctgaaatcgagtcgtatttgaatattgatgaagaaaatagcgaacaatggggtagctatatccaatcttcagctaaaaaatatctcaatagaaccttttctaaaaaaggcttaaatcaacttttacattattatattcgtgaaagtgaaaaccagacattaatttctatttcaccgacattattaaaaaaacatttattaggcttacaacatttttatccaaaacaaactcaatttaaccatattcaagattattttgattatttagaaaaacaatctggcgtattaaataaatttgttttaaatgatattttaaatcatcagctttatattgaaacggaagaagaaaccatcgggcaaattaacggcttatctgtggtcgagtttgatggcgttccccatagttttggtgagccattacgcattagctgtaacgtgcaatatggtgatggagaaattcacgatattgaacgcaaagtggaacttgggggcaatattcactctaaagggattattatcgctcaatcttgtttggcaaatttactggaattaccgacacagcttccgttttcagcgtccgttgcctttgagcaatcttatggtgaaattgatggtgatagttcatcgttagccattttctgtgtgcttatcagtgccttaaccaagttgccgttgccacaatcccttgcggtgacaggggcgattgaccaatttggaaatgtgttaagcgtgggcggtgttaatcagaaaattgaaggcttcttcaatgtttgtgaagcaagggaattaacagggaaacaaggggtgattattcctgcggtatgcgtttcccatttgagcttaaaacctgcagtattatcggcgattgaagcaggaaaatttcatatttgggcggtcgaagatgtctttgaagccttacaaattctgttacagcatccgttttatgatgaagatctacctgaaaatagtgagaaaaaatcacttttcgcgttagttcatcaagggatcgaacagaatgaaaatgaagacgcaagcggttcgattttccacaaaattcgcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtttatcaagcaaacgtaacataaaccgtcaataacggacttttctactttattacaggaacaaaataatgaacacttgtacacctaacatcaaatcaagttatgattacaacgatcttttagcgtcaggacgaggcgaactttttggtagcgaaggtccacaactgccagcaccgtcaatgttgatgatggacagaattaccaaaatcaccgacaaagaaggtctatttgagaaagggtatattgaagcggaattagatattaaccaagatctgcctttctttggctgtcactttatcggcgatcctgtaatgcctggttgcttaggcttagatgcaatgtggcaactggttggcttttacttaggctgggtcggcggtaaaggcaagggcagagccttaggggttagcgaagtgaaatttacggggcaaattctaccgactgccaaaaaagtgatttatcgtatcaatatgaaacgagtgatcaaccgtaagctcgtgatggggctggctgatggcgaagtcgaagttgatggcagaattatctatactgccacagacttaaaagtaggtctattccaagatacaacatctttctaatttttcgatctatgtcgaaaaaataaaaattgcctatttacaaaatcctttcaacatctaatatctctctcactttgggagagatattatgtttcgtgcgatcactattattgaaactttatttgcgatgagcataatggcaatcgcactctatttcttttcccccaccttattttatttacaagatcatatcgttttaaataatgaaatcgatcagataaagtcttttatttatcaaattcaagctaaagcacgttatcaaaaacataattattctatttctatcagccagaatttagcagataaaaaatggtgtatggtcgcaattgaaaaagtcagtgataaacagatcgcttgtaactgtttaaatatcgcaagttgtgatattcaaaaaagctattatctctatcaaacagaaaacgccgtagtcaaaaataatagtttatatcctaaagtttttattaatgttgatggaaagtctgggcgattagagtcgaagtgcttaagggttacggtaaataaaatctatgaaatattacaagtggaacaaaatggagtgattaatgttattcaaaaaggcaaacgcaccagttgttaatcacgcatttagtttggttgaaatattattatcattatttctaggttgcattattttatggagtttatcttctttttatagtgatagctatcgaaatcaaatcaaacaacgggaattattgaatttacaaaagcatactcaccaattacttgagtattttcaacaacatattcaacattttaattatcaaggacaaaatagaaaagaaaccaattatagtttatttgtaaacgataataagcgttattcactgaacaatccaaattgtctaatgtttttctatgatttaagtagtgatggctgtgtaggtaatcgaaataaaaaacaatcttgcgaaataaatggtgtaaataataccaaagaggtaagccgagaattttttggttttaaatttgagaaaaaagcgatttttatttatgaagatagtcaaattcagttctgtcaccaagcagattgtgaaaaaatcctaacaaattgtcaaaaaggcaactggcgaaaaatgtcagatatgtctgattataatgtcgaaaatttatcttttgagtggcttgagcagaatagattattgaaaatagaactggctctctcgtctagcaaagataaccaactaagatataaagctaccgcttatagttacctattaaatggaagtgataaatgaaacgttattatccagccagtattttattaattaccttgatattattaagcggtctgtttgcagtaatttttctcaataaagatagcttattaaaacaagaaaaagtgagcctattctattatcaacaatatctcaccgataaatatcaacttattgaaaagttagcaatagatcctgaaatagaatgccaaaatcagaaacagactaatgttatttttgagtttaaggtaatgaaatacagttttcattgtcaattttcatctatttttgatccttttaaaccaaccaaagaaaaatatattcaagtggataaaattgaaaactggttgaatttattaccttatcaatcggaaatatataaaatcaatcatttagcggagttgccagaaagtagtctagagaatccaaaaattgtgattgcattacaagatattaatgaaaagttagaaaaagatttttacggtattgtcattaccgattatttatttgatcttacaggaagaaaaagaatgtatggtacactttattccacctatgataatttacgagaagaaagaaatctcagttataaaaaagaagttattcaacatctggaaaataaattttcatcttggcactatttgccttattcacggaatatattagcaaatgaataagctcattaaagcagaaagcctgacatcattaatggtcgttatgttgattttttcagtgatatatttagcttatagccgttggcaacatacgcaaaataagcaaagcgcgcttatttttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttcagcaacagcaagccctacaaattgccgaaaatcagattgcgttactaatggcagggaagccctgtgaaaacgaaatccgccaaaatgaacagatatttaaggtagaatgtcgcagtaatacacttaaagtcagctttgcaagcggtgagattgtgatcaccaaatattaagaaattaatggttttttgtattgaaagcagttgtatatatgagtttaagaattggtaaaatgtggttgtaaactataactttagaaatgaacataaaaataattgtgagcttcatcacatttctaaaatgttacattgcaatggattgaagtcagggattgcgagtgatagcattttgccatttcttagcaatggaattgatgttatgccgttaccaaattatcaccaagatcccactttatttcacattaacaccacaccccatcacgcctattttattccctttgcgacacaagataagctcgccccccttgagcgtgaacaatctagcctatttaccctactcaatggtgaatggcaatttaactattttacgagcgtgatggatttgcctgaagattttctttctcagccttttgagcatcgcattcctgtgccatcaaactggcagacacaaggcttcgatcagcatcaatatacaaatatcaactacctattccctttcgaaccgccttatgtgccacacgataacccttgcggtgtatatcaacggacattccactacgagcctaaatcgacaaaacgctatttactgaattttgaaggggtggacgcttgcctttatctctatctcaatcaacaatttgttggctatgggcaggtcagtcattgcacaaacgaatttgatgtcaccgactttttaatctctggggaaaatcagctcaatgtcgtggtgcttaaatggtgtgatggtagctatttggaagatcaggacaaattccgtatgtcaaggattttccgagatgtttatctgctggaacgagaaccaaattatctacaagatttctttatcaaaaccagcctgtctgaagcattagatcaagcggatttatcggtcgaatgtacctttctgcaatcgccacaacagctcactttccaactgtttgatccataacatcgcctaatcgccgaacagacaagcgatcactttaaggtaaaaattgacaaaccacagctctggaatgccgaacagccacaactttacaccttacaccttgcctatggaaacgaagtgattgaacaagcggtcggttttcgtcggatcgaagtcaaagacggtgtactcttgctcaacaaccacccgatcaaattccgcggagtaaaccgccacgacagcgatcccctaacgggttatgttatcagccgtgagcaagcagaacaggattttaggcttgatgaaacaacataacatcaacgctattcgtaccgcccactacccgaatgccccttggtttagcgaattatgcgaccgctacggcttctacctgattagcgaaagtgacatagaaagccacggtgccagtatgcaatacgttccaacgccagaacacagcattttactgaatgtagcaaaacaagatgataaccaacgtattcagcaacaaacgatagataatttctgctattttgcccgacacccagactacaaacaagcaatcttagaccgtacctacgctaatgtagaacgagataaaaatcgcccatcggtactgttctggtcgctgggtaatgaagcaggttacggggaaaattttgaagccagtgcaaaatggatcaaacagcgagatccaagccgtctggttcattatgaaagtaccatttatcaacattctgaacatcgcaatgatcttaccccgttagattttcatagcgaaatgtatgccagcacagaagatatggatcgctattttgaacagccacaaaccaaaccattcctactctgcgaatactcgcacgcaatggggaactctaacggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaacggtgatttagaagattatttccaaacctttgaaaaatatgcaggggcttgcggtggttttatctgggaatggtgcgaccacgccccatatcttcctgatggatcaggacatttcggctatggcgagagtgaaagttacatcgacaaacaccacacaatccgactaggtctataccaaaccactgccgagcaaaattatcaagactacgtcaaaccacaggaaaacggcagtcactacggttgtgaatatcttcatacccaagatctcgagattaccgcaccacagccgttcagcttcaatttttccccttatacacaggaagaattgaccctgaaaaaacatcattacgaactagaaaaatcgccgtatcacattctgtgtgtcgattataaaatgagtggtattggttcgaactcttgtggaccgaatttgaaagaggggtatcggataaatgataaagagataagctggataattcagctatatatgaatacctaatataaaatgacaatgagtaaagttgtgtctatccccatctggtacaataaaggatagacataactttaagtgctatttaatagactctagttttttaattaaaatctcttctggcatagcctgaattctccgcataaagtagaaaaatagccctgcggctaaacttaagcagacacagaatgtcagccaaaatcctgttgccgccatcggctgaacgatccaatcggtgcgagccaaaatagtgcctagtggcattccgattaaccagtagcaaattaaggttgtcagcaaaataggtttggtatttttataaccacgcaaaatgccattgcataccgcttggatagagtcggggatttgatagatcgctgcaaaaatcaataaactagatgcgattgcaatagaagtcggatcgctggtaaaggcataggggatcagatctttgagcagtaaaatcaccattgccagtcccattgcgaccattgcacccgtaaaaatggcgtgataagtcagatattttgtttctgcaacacgcttttctcccaacgtttgcccaactaaaatggttgtggcaatgctaaatgagagtgggatcataaaaaagagcgagctggtttgtaaggcaacctgatggcttgccaccacttgtgagccaagcggtgagataatcaaggaagatgccgcaaacagcatcacttcggtaaacagtgcaaaccctatcggtgtaccaagtttgaacagtttgcttaaggttgctttacagggtttttcgatccatttttcaaatagacggatatccttttgtgctggattggtataacaatagtgtaaaatcagcccaaacattacccagtttacgattgccgttgccacaccacaaccgaccgcccctaattcaggcatacccagtttgccgaaaataaaaatatagttgagcggaatgtttaaaattaagccaaaaaaggtgatatacatcgctggtttagggttggatagtccgtcgttaaaacagcgtaagttcaccgcaagcaaagctggaataatcccgacacttaaagcggtaagataatcttgtgcttttcctgaaaaggcttttggggtatccattagttctaaaatcaaatgagcattgagatagataaaaattaacggtacgctaagcattaatacaatccaaacaccttgacggatttgatgtgcaatcagggaacgttggctcgaaccgttcagataagaaaccgttggggtaatcgcatttaatatccccagcacaaataaaaacaagggaaagtagatcgaattactgactgctatcgccgacacatcatcatcgctgactaacccagccataataatatccgccagtcccattcccgaagcagctaactgagagatgaaaatcgggatcgaaagtttgaataatttttgcgtattttcaggatatttctgccattgaaagttcattctatctaccttttaaaattcaggtttcgcttcaaatgtcatcagttcttgcgtaactgggtgcgtaatggttaatgcttctgcgtgtaaacagagccttggcgatagactttttgccaacggatttgcataaaatttatcccctacaattggatgccctaaggctaaacagtgtacacgtaattggtgtgaacgcccagtataaggggttaatttcacccttgtggtgttattgggataatgtgcaagaatttcataaaaagtaaccgcttgtttgccccgttcgtagcaaattttttggcgtggacgattttcccagtcgcaaattaacggaaaattcattgtccccgtatcgccaactttttcgcctaatttgccccaaactaacgcttgatagtgttttttcggctcacgttcacgaaattgacgtttgagttctttttccgcctgtttgcttaatgcaaacaacaaaataccgcttgtcgccatatctaaacggtgagcaggctcagtaaaaccatatttctgttgtacacgcaccatcgcactgtcttgatattcagggcgatttccaggaacagaaagtaagccacttggtttattaatcactaaaatatgattatcacaataaacttcgtcaagccaaggttcaacagggggattgtattcgattaatgccatagaaattattcactgatttgtagcaaagtcgcaattttagcttttacttcgcttaactgatgatggttaattttacctttaaatttagcgtgacgaatacgccagtcaaggcttttaatttgatcggaaagcacaacattttggggggtacctgcaatattgacttcgaaaggatagccttttacttttgttgtgagcgggcagcaaattaacaaccctgtttgacgattataaatcgtgggcgttaacactaatgctggacgatggccagcttgttcatgtcctgcttgcggatcaaaatcaagccaaataatatcaccaacgtcagggatatactcttgagtagtcatagcatttccttgccaacaggcttgccaaaatcgacttcattgtgcaaattatcttcagtaatacctgaaagaagttgctctaaattatatttaggtttaatcggctcaataattaggcgaccatcaacttcttgaatatcgactaaactctctgcctgtaatttcaatgaattagataataaagcaggaatgcgaatgcctacgctatttccccattttttgacagccacttgcatataggttcctttaaaattatacaaagtataactctgcggattatagagaaactgtcgccatttgccaactttttctataatttctatctgttgcagaaatctcttgttttttataaaaaatagcgtatcttttgcacgttcattttgaacattacaatttatttacatttcttttggagaacaccatgaaaccgctttttgcaagttttgcaactgctttcaccgctctcagcgtgctgtttagctcagttgctatcgcatcaccttccgataaaacctttaaaatcagtgctattcctgactataacgctgccgaaatgacccgttcattcgacagttttgctgagtatttaggcaaagaaacagggttaaaggtgcaatatgtgcctgtcaccgattatgctgccgtagtcaccgcattccgtcgtggcgaaattgatttagtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttaaaggtgcaatatgtgcctgtccccgattatgctgccgtagtcaccgcattccgtcgtggcgaaattgatttagtctggttcggtggtttaacgggggtacaagctcgtgccaaagtacaaggtgctgaagctatcgcacaacgtccgcaagatgagaaatttaagtccgtctttatcaagcaaaaaggcttagataatgtgaaagagattaaagatgttaaaggtcacacccttgcttttggtagcgaaagttcgacatcaggtcatttaatgcctcgctttttcttaacggaagctggaattaaccctgaaaaagacttagacgctcaaccgacttacagtggttcgcacgataaaacctacggcttagtagaagcaggttcagtgcaaatcggtgcagtaaataagcagtactgggataaaatggcaaaagaaggcaaggttaatcacgataaagtcgagcttttttacaccacaccagattactatgattacaactggaccattaatcttgttgataaaaaatttggtgacggtaccaaagagaaagtcaaagctgcattattaaaagccgatgcgtcaagctcgcaggtgatgaatttactctctgccgagaagtttatcccaacgcaaaacagcaactatcaagatattgagaaatcgttgaacctttgctacctgtggttaaaaaagatcagcagttatggtgtgaaagcggtgagatcgtcagcaaaaaaacacagcccccacgccattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccaccacaccaccaaacatttcggcaagcaagccgttttagacgacatctgtttaaccattcattcaggtgaaatcgtggcattagttgggccgagcggttcggggaaatcgacattaatgaatagcattatgcgttccgtgcctttaacaagcggtgagatttggctggaaaattgcaatattcaagattacccagataacaaacagtttgctcaacaagtcggtatgcttcatcaacagtatgatttagtcaaacaactggaagttatccacaatgtcttggctggcagactgaaccagtggggcttttggcaatctttgttctctttggttaaacctcaagaaagacaccttgccgagcaagcacttgctgccgtcgggctattggataaaatcgatcagccgacagctgaactgtcgggcggtgagcagcagcgtgttgcaatagctcgtctgttagttcaaaaccctaaattgattttagctgatgaaccagtgtccgcactcgatcctgttaatgcacaaaatgtcttggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcggcattaaacagggaaaaattgtgtttgatttgcaaacagaacaagtcactcaagagcaacttaatgtcttatacggattggtaaaaaatgaaacataaccgaccgcttggactaaatgaacggcgaaatttgctgacgggcatgttgttgcttgcatttttgttgagcctatttgctgtggataacgacaaagggttgatgcattctggtggttgggcaacgcttaatcgactattttccagtttattgtcccctgacttttctactgatttactgaaactcgccttgcaatccacttggctcacttttgcttatgccttgattacactctctttgtctatgtttggtggattttgcttaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttttgcttctggtgtgctgtttcgttcactcattttgcagggggcagctcgagcgatattgggttttctacgtgctattcacgaattgatttgggcatggttctttgttgcggctgtcgggttaaatccgataggtgcagtgtttgcccttgctattccttattctggctacttaggcaaaatctatgcagatacgttacaagcggtgccttccaaacctatttttgcgttaaaagaagcaggggcaacgtcgatgcaatgtttgatttatggctatctaccccaagccttgccgacgatgttgagctataccatgtatcgccttgaatgtgcgatccgctcttcatcggtactttcttttgttgggttaggagggatcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgttgggttaggagggatcggtatgcaaattcagctttctttacaagatctgaaatatgatcaggtttggacattcttgatcttccttatcgggttaatcgttctggttgaccgctggagctatgccatcaggagccgagtaaaatgagaaaacatatcgaccgctattttatccgctattcattttgggctgtgttaggacttatcgggctgtcgtggggctatattcttaaagatcaacccactgcactgagtgaactgtttcgagcggaaaattgggattatcttacggaatttttagttggaatggctggtgtgggtgaagagctacctgcctatcttgaccctgaaatgtggcaaaaagccctatggctctcgtaaacctttgtgatgagtattctggcaacaggcattgcaggcatggcgatgttccttttggttctgccgtccgctcgcaacgtggcacagggacactttcgccacagaacatactggtatcatcgtgtcgcttattatatcagtcgggggctatttctgtttagtcgatccgtaccggaattgatgtgggcgatgattttagtctttatcttcaaaccagggatcattccaggtgcattagcattagccattcacaatttcggtgtattaggcaaactgtgcggcgaagtggttgaagatatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaaccgatacgccatttaatgcaaaatggggcttcacaaaaccaaattttgttttacgggatctatcctgctgtgatgcgtacttttctcaattacattctttatcgtatggaaaacattattcgggcaacgctgattgtcggttttgttggggcaagtggtttaggtatgcagtttaaactggcgatgagttttttccattactctgaaattaccctttatctgctctgttatttgctgttagtctatgtgaccgatgcactgtcggcgttggcaaagaaatttattgcagaaaaaaattgaattattttgataacataatgtctactcttaactattttttattaaccaaaaggaaagcaatatgaattttaatagcattttaaacggcgttttaaaatctgtcggcaacaccgctaatcaaagtaaatcggacttaggtaacgtattaagctctgtattgggttctgccaaaaatactgccggtgagatcaaatctggcaacgtagatactattaccaaagttggtggcggtgcggcattagtcggtattctatcaatggtgttgggcagaaacggcggagctaatttgactaagctcggctctttagccgcacttggtggattggcttacaaagcctatcaagattatcaaaagaaccaggcaacaagccaaacgacagaactaagccaaacagcttttgaagcggatagttcggaagagaagggagcaattattttacgtacaatgcttgcagctgcattagcagacggtgagctggatgagaacgaagaagctttaatcttaaaagagggcggtaatgaccctgaattacaacaatggttactgcatgaaatgcacgagccagtatccgtgaatgaaattgcaaaaactgtcggaaacgacaccgctttagcggcacaagtttaccttgctgcacgcttggtctgtcaagagctctctagaaaagagatcgtatttttatcccacttagccgagaagctaaatttaaacgaaaattttgtagaacaattagaaaaacgggctggattctaacattaaacatgattttcccacaaattcactattttgatagttgttaatgtttatattatgtttaataaatgagcacttgtttttttcgataagaagaatgaaataacatattgttttttaaaggaaaaaagcaaaatatctgggctgattttaggttatacacgatcattatcccgatctatcacaattttatccacagggaatggggataaaagcacatcaaatgtgaatagaatggcaatttagtctgaaaagtggttaagttatcctagaaagaaaataaaatgagcgattaaatgtgtgcttatacagtgaaaagggatcgaaaatgatcgatggcaggaagtaagatctgaattaagatcaagcggttagataacttatcccaaaaaagttatcaacaaattttcaagttatccacagagttatccacggttgcgaaaaaatttggctatctcaccgcttgtttttgccttgctagttgttcaaatagccgaaatatgaaacaatcacaccattttcaaattgattaaataaggcggtctaaattgatcgatttcgatggttaccgcccgaatgttggtatcgttatctgtaataagcaagggcaagttctgtgggcgaagcggtttggtcaaaactcttggcaatttcctcaagggggaattaatgagggggaaaacattgaacaagcaatgtaccgtgagctttatgaagaagtcggcttagcgaaaaaagatgtgcgattgctttgggcatcgaagtattggctgagatataaattaccaaaacggttagttcgtaatgagcaaactcaacctgtatgtattggtcaaaaacagcgttggtttctgttgcagttagtggcagacgagggggctattaatcttaaaaccagtaaaacgccagagtttgacggctggcggtgggtgagcttttggtatcctgtgcgacaggtggtgtcgtttaaacgtgatgtgtaccgcaaggtgatgaaagagtttgctcaggtgttgatgggtgagcagaaaaaagtcgaaagcgagaaaaatcgagataacaaagagtttacccacgagagaaaagagtttcgtactcagccaaaacgtgagcttcgtaaaccatatcgggtgtttaaggggaaaaaatgatggtggaaatgtttgtctgttgcttgattttaggctcagttgctggttttttagcagggttgtttggtatcggtggcggtatgattattgttccaacccttgtgtatttgttgcctcaaattggtgtgccagatgatttgttgatgtcgattgcattgggtacgtcgttttcaacgattgtgctaaccactttttcagcggcacaacgtcatcataagttaggcaatgtacaatggtcagttgtgaagttttttgtgcctgcgttgatggtggcggtgtttatttcaggcttgattgtgagtgatctgccaaaaagtgtaatgacaaaaatctttgcggtgatgatcctgtatctttcgctgaagatgtttttatcgctcaagccaaagcaagcagagcctaagcctctgactactcaatctacgttgattgctggaggggtaattggggtgttatccagttttgctggcattgcaggcggtgcttttattgtgccatttttaaatagcagagggattgagctgaaaaaagcgattggcacttcttctttttgtggtggtttattaggattagctggagcgattagctttgtgattagtggttgggataatcctaatttgccacaatatgcggtaggttatgtgtatttacctgcgttggtggggattacgctgacctctatttttacctcaaaattaggggcaacggcagcgaacaaattacctgtgccgattttaaaacgtgcttttgccgttttcttgatgtgtgttgccgtgaatatgtttttaaaataaaggaaatttatgtctgaacagtttttaacttttcctaatatcgatcccgttgcgttgcagttaggtccggtttctttacactggtacggcattatgtacctgcttggttttggctttgcctattggcttggtaccaaacgtgcgaaaaattctaatggggtatggagtgtcgaacaggtcgatcaactgctgtttaatggcttctggggcgttgttctagggggaagaattggtgatgtgttcttttatagctttgaccgtttcctacaagatcctctctatttatttcgtatttgggaagggggaatgtcgttccacggcggtttacttggtgtgattgtcgcaatgctttggacctctcgccgtcaaaatcgcaacttttggcaaaccgctgactttatcgcaccgcttattccttttggtttaggattaggacgtattggtaactttattaatgatgaactttggggacgtgtgacagatgtgccttgggcgataatgtttccaagtggcggttatttgcctcgtcacccctctcaactttacgaagcggttttagaaggcttagtgctgttctttatcctcaatggctatatccgtaagcctcgaccgggctcggggtgttccgttttatcgttgaatacttccgagagttcgatccaaatgtaaatacggcagcggatttaatcacacgagggcagttgctttcattaccaatgattatcgggggattggtgattatggttgtggcttattaccgacataggttaagtaatgactaactaaaattagtttacattttttatttagttatatggcagcagaataatagctaattatgttttaggtaatctcaatttataatgaatattttgatagggcgtttccaataattctatattgtgctatagttcgcactttgataattagcttctcattcgcatctgagtaagaagcactcagcccaaaaattgtagtaatggcaaagcaagattcggattgtattacgcttgatctgtttgaaaatatgccaaaggttgggcgacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttgggcgacctcgcacaaatcctctaagcggagagcaacaagttagaattaataaacgtaatcaactcaggcgagatcgttcgtcaggattaagacggattgagcttaaattgcattcggatttggtagcggcattggaacaagaagctgcggtaaaagggctgtctagagggcagttaattgaactcattttaaacgattatctcaatggagattccattgaattaagtaaataggtatttcaaatggcagttgtcggtttattttacggtagtgatactggaaacacagaaaacatttctaaaatgattcaaaaacaactaggtgaaaatctagtggatattcgtgatattgcaaaaagcacgaaggaagatattgaagcctacgatttcttattaattggtattccaacgtggtattacggtgaatctcaagcagattgggacgattttatgccgacattaaaagaaattgattttacaggaaaaatcgtgggtatctttggttgtggcgaccaagaagactatgcagaatatttctgtgatgcaatgggaactgtgcgtgatgttattgaacctaatggcggtacaattgtcggtcactggcctacggaaggttatactttcgaggcttcacaagcattaattgatgatgaaacctttgttggtttatgtattgatgaagatcgccagccagaactcaccgaagaacgtgtaaaccgttggtgtaaacaaatttttgatgaaatgtatttagcggaattagcttaatatatctattggaggatatatgtctgaagaaaatgtgaaattgttgaaaaaagtaggtttaaaagttactgggccacgtttaacaatccttgagttaatgcaaatcacccgtgatagtatgcagcatttttctgctgaggacatttataaattattgctagaacgtcagtctgaaattggattagcaacagtttatcgtgtattaaatcaatttgaagaagttggcattttaactcgccataattttgatgcgaataaagccgtctatgaattaaatatgaaccaccagcacgaccatattatctgtatggattgtggtaaagtgtttgaatttaaagactctgaaattgaacgccgtcagcgtgaaatcagccaacaacacggaattgagcttgcaaaccatagcttatatttgtatggtaaatgtagcaatattcaaaaatgtgatgagaaagacaaaaaataattcttctttttcaatgagttaataaacacaagagcggtgagatttcgcaaaccttttgcaaaatctcgccgcttgcttgtatttaaaagtgataaaatgatgtctgaaaatatgccaaacagtattcctgctaaaattagacagcctcgtaaaatttcgccattttggttattgccaattgtcgcttttgtgattggttgtttgctttttttccaaattcttcaagagcaaggacagaaaattaccattcgttttagtaaaggcgatgggattactgcaggaaaaaccgctattcgttatcaaggcttgcaaattggtcaagtaaaaaaagtctattttatcaatgagttaaaagaggttgaggtggaggcggaagttaatcccgaagcgaaatcggtattaaaagaaggaacaaagttctggctagtcaaaccgagtgcctctttagctggggtgtcggggttagatgcacttgtttcaggtaactacatcactttattgccgaatgatgatgaagatgcctctagtgaagatgaatttgtggctgaagatgaaccgcctgcggtaactgttgctgatggcgatttattggtgaaattagttgcctcagatttgggctcaatgactgtgggggcaagcgtgtattatcgaaaagtgccagtgggaagcattgccgattaccgctttactccagatcaaaagaatgtcgaaattgacgtagttattgataaaaaatacgccaatctcgtcaaaaaagaaagtcgcttttggaacattagcggtattcaatttaatgccaatcttactggcgtaaatctcaatgtagatagccttgcttcaatggtgcaaggggctgttgcttttgactcgcctgagatggcaacaaatgccaaacagggcgaacgttttcaacttttcgataacttaaaattggctcaacgaggaacggaagtcaatatcaccttgccaataatgccgaatttaaaagtaaatgaaacgccggtatatttccaaaacctgcaagttggcgtactttcacacctcgaactgaatgaaaccgaacaagattactttgaaaccaaaccaaccaaggcgactattcaaggtaaattattgatcgaccctgcacatacggatttattacgctcaggcagtcaaattctcctgaaagaacctaaatttgcactcaataaagaacaattgagtaaagtgggtgagctattgagaggggcttactttgaaattgaaaagggtgatggcgagcctaaactgacgtttaatgtacaaaaagaagctgattatttgctcactcgtcctaacgttttagcaattaccctttcatcgccgcaatcttatggtgtaagcgaagggcagggcatttattataacgatatacaaattggcgaaattgtgaaacgccagttatcgcttaacggcgtagaatttcaaggcatcatctatccgccttatcgtacccttgtcgcagggaacagcaaatttgtggcgatttcacacttagatattgctgttggcttagatggtctaagagtacaatctgcttctccatctgaatggcttgctggcggtattcgtattctctcagataaagctcaaggggaagcgaaaaaacaatatccgttatacaaagatcttgagagtgctgaagctggtattgtaagcggtgagaaaaaggcaacgctgagtttgtctgctacagaattatccggcattgataaaggctcacaagtgctttatcgcaacttcccgataggtgaagtacttaatattcgcccacaaaaaacgaagtttgaagttgatctatttattgaacctaaatatcgccatctgctgacggaaactagtcgattttgggttgagcctgcggtagatgtaaacgtgtctaccaacggtgttaatctcaaaatgggttcactaatgcgaacactcaaaggggcgattagctttgataatcaaggaactaaaggtaacaaaaccttatacagcagttatacgaaagcgacttctggtaatacttatatcaccttgattgctcaagatgcttctaaattaagcaaaggaatgccgattaagtatatgggattaaccatcggcaatgttgaaacgctacagctagacaatgcaaaaaaacaggttaaagccaccgcttacatcgaaggacaatattatgccatcgttgccaaagcaggtagcaaatttaatgccgtttcccctgaaattgacacaacaggcttcaaaaatcttgatgccgttattcaaaactacatcagcgtagaagccggaaatggcaaacgaaaaacacagttcaaattaggggcaacggacaccgcagatacacaatacggcaacggcttcccaatcattgtggaaaccacagacgcaaatggcatcacccctcaagcccctgtaatgtatcgaggaatgcaagtgggtatggtacaacagctcagtttaagcgaactcggcgaccgagtgctgatccatttacgcatagccaaccaatataaacaccttgtccgtaaaaatagcgagttctgggcttcgtcaggctatacaatggatattagcctcaatggtgtcagtatgaactcaggcacaatgtctcaattatttaacggcggaattagtttctcaaccccatcaagtaaggttgttcaacctcaggcagaagctaaccgcagatttttattacaacgtaaattacctgaagaagcattagagtgggatcaggggttggcggagtaggaaattcatgtaacagacaaaacattctgatttaaatatagaaaagatggcaaatcgtttagagggatcatttagtgaacttaagcgaaaattaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaatggttgaaaatttcaacgggcagcattacaacatttatcactgtataaggcaaatattattttaaaaaataaaatttttactaaagaataaggaacttattggaaagtctatggactactgtaactaaataaaatatagtaggcagcatttttattcgcttacctaacattcattttttagattggaacattttatgtctgaacaacaacttaataccattcaaaacctaaaaaccgctttatctacaaaagaaatcattgcttatttggctgaaaaatttccgctttgctttagtttagaaggcgaagctaaacctctaaaaattggacttttccaagatttagttgaagcactgagtaatgatgaaaaaatcagtaaaacggggcttcgtcaagcattacgcgtttatacaatgagctggcgttacttacacgcatgtaaagaaggtgctgtacgtgtcggtcttcaaggagaagaagcgggtgttgttgaagctgcacaagcagaacatgcagcgcaatctttagccgaagcaaaagcagcttatgcagaacgtaaagctctacaattaaaagagaaacgcaaggaagagcgtaaaactttctttaaacaaaaagcacgtgaagcacatgccaaaaaacgggctgaaacgaaaaaacaagaaatgccaaaagcatctttagaaagtttgtccgcattagaaagcaaatttgccaaaggcaagaaatagtcgcatttataggattgatatgaaatataataaattcaccacattacttgggttatgtttgggagtttgtagcataaatagttttgctgcagaacctcaaataaaagaaagtgaattaatcattccaaaaccaacagaacaacatagtatttcaactaaacgtgttacggctcgtttaacacaatcgcattatcataagtttcaactagatgatgctttttctgagaaaatttttaatcgttatattgattggcttgatggttctcacaatacctttttacagtctgatattgatgaattgcgtgctaagtatgcaaccaagttagatgaagaactctatgaaggcaaactagatattgcctttgaaatgtatgagttaatgacaaaacgtcgttatgaacgttataaatatgctttgtctttgttagataaagagcctgatttaaaagggcaggatcaaattgaaaatgatcgtgaaaaagcaccgttcccgaaaactaccacagaagctgatgagctttggttgcaacgagtaaaaaacgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaaattgaaaatgatcgtgaaaaagcaccgttcccgaaaactaccacagaagctgatgagctttggttgcaacgagtaaaaaacgatattattaatctttatttgaaagataagaaatggcctgaaatcaagaaaacactgactaaacgttataacttggcaattcgtcgtttaacacaaaataaagccgatgatattctgcaaacttatctcaacgcttttgcaagagaaattgatccgcatacaagttatctttcacctcgtgcagctaaacgtttccaagagagtatgaacttgtctttagaaggcattggtgcgacgctttcaatggaagatgatattacgatcatcaaatctttggtacctggtgcgccagcagcgcgtagtaaaaaaattgcagcaggtgacaaaattgttggtgtggggcaatcaaaagataaaatcgaagatgtgattggctggcgtttagatgatgttgtcgataatatcaaaggtaaaaaaggttcgacggtttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaggcggcaaaaccaagattattagtttagttcgggataaaattcgtcttgaagacagtgcagcgaaattaactgttgataaagtagacggaaaaaatattgctgtgatcaaaattccaagtttctatattggtttgactgcagatgtgcgtaaacttctcgaacagatgaaaaccaaaaaagcagatgggttgattattgacctgcgtgaaaatggtggcggttctttgcctgaggtagtggaattaacgggattatttattaaagatggtcctgttgttcaggttagagatgcttttaatcgtattcgtgttcacgaagataccgatagtacaacattatatgatggcaacattttagtgatgattaaccgtcatagtgcttcggcttctgaaatttttgcggctgcaatgcaagattacaatcgtgcgattattatcgggcagcaaagttttggtaaaggtactgttcaacaaaaccgttctttaaatatggtttatgatttggatcaagagccgttaggttttatccaatatacaatccaaaaattctatcgaattaatggtggcagcacccaaattaaaggggttgaagcagatattcgtttccctgaaattatcaatgcagaaaaaacaggggaaggatttgaagataatgctttgccttgggataaaattcctgcagcaacttattcagaagtcgcaaaagctagagatgtagttgcacaactcactgaaaatcacgaaaaacgtattgctaaaaatcctgaatttattgctttaaatgaaactatcgcaattaataaggaaagagatgatcgtaaatttacctcacttaatttagcttctcgtcaagaagagagtaaagctgatgaagtacgtcgtttgaaagatttaaatgcacgctttaaacgcgaaggtaaaaaacagatcaaagatcttgaacagttaccaaaagactatgaagctcctgatttcttcttaaaagaaacagagcagatgatggttgattggttacaatttgataaaaaataataaatacgtttataatgtggaagtttatcaggccgctgtttaagcggtctgatttattactcattttcctaatggattaaattgaatgaaaagtttaacttttttgtcagtaatattgttttctagtgctgtggttgctgaaaatggaagtgcgttgaatgttagttctcaacataatgctgcaacgcctgttcctgatgaacaaattttgcctcagttaagttttaaagcgcaattagtccgtattgctgaactgacacaagatgcagaatatcaatttcaattggctgaaagaaaacgcattgaagccgaaaaattaattcatgccgaacaacgtattcaacaagaaacattaggctatcatttactattatccaatacgacagcaaaagtctatctcaataatgagtttgcccctttgtggaaagataaagtggcagaaaaacagtttttaaaagaatatgcagtattcgctgtaagcggcgtttcgcctaaatcggctaatgcgttacaacaaattctaaatatgaatgagggatttgctcgcgatattctactcacagatagtttcttagactatctctattacacagaaaatgtcgatcaatttgcaaatcaatggttatatcatttaggaagttattcaattaaaacaccaacagaatatcgtattgctacttggttggaagcgattaagcaagatcgctacgctcagtttgtcacggatctaatacctaaaaaccatatttaccaagaaaccgtacaaaaattatttgaaatatcatctaatgatgctctcaatcagggtggtaataaatcagcaaaatctacaaaagagaataaaggtagtgtaaacacgccttcatttactcaattagcacttaatgcacagcgtttacgtcttattccaagttttaataatggaatttttgtcaatatcccaagctatcagctctattatttcagagagggcaaacttgttttacagtctaaagtaatcgtgggaagaaatgatcgcaaaacacctgtcatgtacagcaaactgagcaacgttgtcgtcaatccgccttggaatgttccatcaacaattaagaataaagatttagtaccaaaacttcgtaaagatccaatccttgctgataaattaggctatgaaattttagatgggaaagggaataaattcagtgctcatagtatcaactgggcagcttatgaaggaaaaaataatttcccgtatcatatccgtcaaaaagcgggagatgatagtgctttagggcgttataaatttaatatgccaagttccgatgcaatctatttgcacgatacaccaaatagagggttatttagtaaaaaaatcgtgcgttaagctctggctgtgttcgtgtagctaaagcagatgaactagctacgttattattagcagaagctgggtggtcagcgcagagaaaacaggacgttcttgcaagcaaaaaaacaacttctgcacctattcgttcagataatcctgtttatttatattatgtaacatcctggattgaaggcggtaaaatatacaccttacctgatatttatcaatttgataaatcattacctaaaatcaacttagattgggaaaaagtaaaaagtgtgatctagtccacaaaataaaaaatttccgaaaacgataggctattttttagaacttcctttttgataaaatgtcgaagtcaggctgaatatatttaccttcaagagattaaaggagagattgtcggtaaataacccaaatgcgaggataaaatggaacaaacaaatttacaacgccaaagatggcttgcattaggcggaatagttttgggtgcaaccttgttacctaatttagttcatgcggtaacgtcaactccaaaacctcttattctacgtttaaaacgcttaagtacaggcgagaccttatctgctaattatcacactaacggatttgctgcaaaggatcttaacaaattaaatcatattatgcgcgatgtgcatatcaacagaattaagcgaattgacccaaaactattcgtaaaattaactcaaattcaagctcgcttgggtcttcgtaaatctgaaattcttattgtaagcggatatcgttctgctcaaacaaatgctagattacgccgtcgtagtcgaggcgttgctagcaatagctaccatattttaggtaaagccattgatttccgtattgaaggtgttcctcttgcccgcataaaagcggcagcagaaagcctgaataacgggggggttggttattatcctcacagtaattttgtccacgtcgacactggccctgttcgtacttggcgtggttcataagcggtttgattttatgtttaatttgcaaattatccctgtaagtgttttccaacaaaattgttctgtcgtttgggataacgaaaagaatgcggttattattgacgctggtgatgatgcagacaaaataattcggtttgtggaagaacagcaattaaatgtgcagaaattgttgattactcacggtcatcttgatcatattatggctgtcgatcaactgagaaaacattttaatgttgatgtctttggttctcatcaaaacgatcaacctctttttgaacaacttcctaatatttgtcagagctacgggcttcctgcatcgcccgcttttctaccagatcactggttaaatgcaggtgataaaattcaaattggggctttaacattccatattcgctatttaccaggccattcaccaggtcatatcggcttttttgattttgagaataaaattgcctttagtggcgatgtgcttttcaaagatagtattggaagaaccgatttataccaaggtaattttgagcagctcatttatacaataaaaacacaactatttgatttagaagatgattttatcattattcctggacacggatctcataccacagtaggacgtgaaaaacaacacaacccttttttaaagtagtcatatgaaaaaaattaaacttctatttttagttctcaataccgcttttctaaccgcttgtactgcttctattgatcctgaaactggcacccgttcagatccgttggaaggatttaaccgtgccatgtggaaagtcaattacgaatatctagacccttatattcttgaacctgtggcaaaaggttggcgagattatgtacctagcccaattaaaacaggtttagtcaatgtggcaaataaccttgatgaacctgccagctttgtaaaccgattaattgaaggggaaggacaaaaagcgatggttcactttactcgcttttggtttaactctatctttggattaggcgggttaattgacttcgcgagtatgaccaatgatcttaaaattgataaacgtagagaatttggggatactctaggcgcgtataatgtgcctacaggaccttatgtgatgttaccaatgtatggacccgcaacgcctcgtcaagatttaggtcgattagtagatactagttatccagttttatctttactcgctacaccttggagtatcacaaaatatgtcgtacaaggagtagattcccgtgcacagcttataggacaagaagcgttattgaagcaatctcaagatccttacattactttccgagaagcttattttcaaaatttagagtttaaagtaaaagatggtaaaacagaaaatagtgagcaagaaacattatctgaagaacagctaaaaaatattgattgatgatttacctgtaaaaatttacactaaaacgcaaaattcctattgacactgtgtgtttaaacagtaaaataactgtataaacaaacagatttattttagaggattttatggcgtatcttagatcactaacattggcacaatcccatcagcctttacccctttatcgagattctaatataaagcacccaatcaaactggatctctattctctttatgttcgtcgtccttctgaaacctttctggttcatgtgaaaaaccctaatttaattgcatgggggatcgaattagatgatttgttaattgtagagaataatcaatctgctgaagttaacgatcttttggtattagagaaaaatcaagagtataagttctaccaatttttcagtgagattaatggagagaagattttattttctttagacacctcagaacctaatttacgcattaaagaatggagtgatgtaaatatcgctggggtgattacaaatatcgtacatcaagtaaaacatcgcgcattgcaaaaaaacagattgtctaattgataggtataataaataaaatacttgctaatggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaatcttgtataaacaaaatattacgcctttttgttaatcagttatgattatttaatttttgcttaagctcgctaaataatccctctaagcgatttattgtattttctatatttaatttagaatatttctcataggtaaaaataaaatccatataacgctttaagctggtataagcacttcttgcattacgacgtttataagggaaatggtcttttttattggctttatcacttcattcttttaaaaacgtttggcgttttataaactaaggacgtaatcgctaataaaattcattttttaagataaacgttttatgacattcattacaaaagtaaggttgagtattattttgtataccatgtttctttattttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttacttcaactgagcaaatgcttgtagcaagtctgctttaatatcctcaacgtgttcaagccccaccgaaaaacgcaagagcttattacatacaccacgagcgatacgttctgcttcaggaatatccatatgggtttgggttgcagggtaagtaataaaactttctgtaccgcctaaactttccgcaaaggtaatcatcttgatcgcttttaagaatggattaacccagttttcatctttcaagcggaaagataacataccgcttttaccagaataaagcacatcttgcacttgcggttgttccgataagaatttagcgagttcagtggcattttgttggtgatgctcaacacgcaacgcaagggtttttaagccacgaataatcatataagcgtcaaacggtgaaagcaccgccccagcaccattttgcaaatagaacaagcggtcacataacgcttgcccttttgctaccaccaaacctgctaacacatcattatgtcctgccaaatatttggttgcactgtgaataacaatgtctgccccaagttcaatcgggcggaataatactggtgttaagaaagtattatcgacaatcagcagtaaattgtgctttttagcaattttcgcaatcgctgcgacatcacactcttccatcaatggattagacggtgtttcaacaaaaatcgctttagtatttggattaatcgctttctcaatagcatcaagaactgccgtgttcacataaacaggcttcacagtattgttatttttatagctaaaatctaacaagcggtaagttccgccataaacatcgctagagataatccactcgtcaggggcagtaaagagcgacatcaccagttgaattgccgccatacctgaggctaacgcaaaacctgcatcgccgccctctaagtccgcaatgccttgctcaagtacactacgagttgggtttttggttcgagtatagtcaaatccagtagactcgccgatccccatatgtccataggcagtcgaaaggaaaatcggggtcgccaccgcaccggtacgctcatcagtacgattacctagttggactaaagtactttcaatgttgttatatttcatatctatccttttgcaaaattttgattaaatctgaccgcttttctttattataaattgtttaaatccaacacatcggtcatatcaaaaagaccgttttgtttggtttgaagccattttgctgcacgcacagcaccgttagcaaaagtcattcggcttgaagctttatgggcaatttcaacacgttcgccttcatcagcaaaccaaacactgtgttcaccgactacatcacctgcacggatcgtcgcaaaaccgatttcatcacgcttacgttcccctgtgatcccttcacgcgcaaatacgccgtgcgtttttaaatcacgacctaaggttttggcaatatgctcacccattgaaagtgccgtgccagatggtgcatcaactttatggcggtggtgagcttcaatcacctcaatatcgtaataatcgcccatcacttttgccgctttttctaacagtttaaatactaagttcaccccaacgctgtaatttgaagcaaagacgatactgattttttccgacgcagatttaatcgcctgtttgcccgcatcatcaaaaccagttgtgccgatcaccatttttttattatgtgcgacacaaaaagcgatgtgttccaacgtcccttcagggcgagtaaaatcaattaatagatcaaaatgattgagctgtgaagctaaatcgtccgtgacagtcacgcctaaatgcccaataccagccaactcgccagcatcagccccgactaatgatgatcctttacgttcaaatgctgcacctaattccacgccctctgcgttatttacggcttggatcaactgacgacccattctgccaccagcaccgacaacgccaatttttaatgtcattataaatcctctataaaatgtcgtgataagcggttggattttacaagaaagttacgtttttgaatatagaaagataagttgccaaatagagcaaacccgatccgtgaagatcgggttaggctatcgcaaatcgcttattcaggtcttacccctaaagtatgacaaatagcataacttaattctgaacggtttaaggtataaaagtggaaatcttttactccctctttagagaggattttcaccatatccattgcaatacttgcccctacaaggttacgggtagtttgatcatcgtccaaaccttgatacatttttgccatccagctagggattttcacattagtgatttttgccattttttctagctgtttaaagttcgacacaggcaaaatgccaggcacgatttcaacatcaatccccaccgttgcacaacgatcacggaagcgaagatagctatcaatatcaaagaaaaactgcgtaatagcacggcttgcacctgcgtcaattttctgtttcaaatagagcaaatcagattgtgctgattttgcttcagggtgaacctcaggataagcggcaacagaaatctcaaaatcggcaacctcttttaacagttttactaaatccgacgcataaaaaggtttcttcgcatagcctgcaggttcatcaccacgcaaagccacaatgtgacgaatgccactgtcccaataatcttttgcaatagcacgaagttcgtcaaggggtgcatcaatacctgttaaatgtggagcagcgacaatccctgtttcttgttgaatggtttttacgatagagtgcgtgcgattacgttccccagagtttgcaccataagtcacagaaacaaacttcggtttaagcactttcaaacgatgaatagagtcccataacagcgtttccatcttttcatttttaggtggaaaaaattcaaaagacacattaattttgccgtttaagtcggcaacactttgatttaaaagatcaatctcttttgcataactcattcaacacctctatcgagcttccattgttgttatttgtataatgtttagtttgcatactgccgtcttttttagacgtttagatggctaaaactttaaaatgccagcgatatgatgtcaataaaattattttcattatttcatgaatttaatttatgtaacttgcagataatgatgaaaatttttaaatgtaaattttttgttaaatttgttatctgatggtattatcccgttgcttgtaaaaaatacaacatctgcagtttttattttcaaactcaattaagcggtatcaggtcgcatttaagggggaaataatgctatctcaactcactacaccaaaagggcaagctattcaactaaatcatgatggttcattgtctgttccaaattacccaattattccttttattgagggggacggaattggcgttgatgtcacaccagccatgcgttttgtaattgatgctgcggtagaaaaagcctatcaaggtcaacgaaaaattgactggttagagatttatgcaggggaaaaagctaaccgactttacggtgaaaacacatggctacccgaagaaacattagcatcaattaaacagtatcatattgcgatcaaaggtccattaatgacccctgtcggcaaggggattcgttctttaaacgtagcaatgcgtcaagagttagatctctataattgcttgcgtccaatccgttactaccaaggtacgccaagtcctgtgaaatatccagaattagtggatatggtgatctttcgtgaaaattcagaggatatttatgctggggtagaatgggcggcaggttcctatgaagctgaaaaagtaatcgcttttttacagcaggaaatgggcgtgaaaaaaattcgctttacggaagaatgtggcattggtattaagcccgtctcaaaagaagggactcagcgtttagtgcgggctgcattacagtacgcgattgataatgatcgtaaatcactcactttagtgcataaaggcaacatcatgaaatttaccgagggggcatttaaagagtggggataccaagttgccaaagactttggtgcagagccaatagataatggctcttggcatcgtttaaaaaatccaaatacaggacgagagatcatcatcaaagattgcattgctgatgcttttttacaagaaattttattacatccaagtgattacgatgtgattgcaacgcttaatcttaatggtgactacatatccgatgcacttgcggcacaggttggcggtattggtattgcacctggtgcaaacataggggaagaggcggctatttttgaagcaacgcatggtacagcgcctaaaatcgcaggtcaaaacaaagcaaatccaggctcgatcatactcagtggcgaaatgatgctacgacatttaggttggactgaagcggcagatttagtggtaaacgcagtatccaaaaccatctcaaataagacagtgacctttgattttgcggaaacattagagggggcaacactccgtacaacttcggaatttgcccaagatattgtcgccaatatgtaaccacttatacacatagagataatcatgcaattttgtgatcttgttaacaaaatgtaaaatttgttaaatttattgcttgtcgtttttactctctctgttatgattatctcatcgctcattttttatctatattgaagtggggatcatcattatgtctttcttaactgaataccaaacacatgtttttgaacgagctgcacaaggtattgtgccactgccattaaattcagcgcaaacagcagagcttattgaattacttaaagaacctgctgatgcagataaagcattactcttgcacctctttgaaaatcgaataccagcaggggttgatgaagcagcctatgttaaagccagctttttagcagccttagtaaaagggcaagcagtttcgccgctcatttccccacaacaagccgtcagcttgctaggcacaatgcaaggggggtacaacattgaaccgcttgttgaagcacttgatgatccaagccttgctcctattgccgtcaaagcactctctcatacgctcttagtatttgacagttttcatgatgtggcagaaaaagcgaagcaaggaaaccgctttgctaaagaagtattaacctcttgggccaatgctgattggtttttatctcgtccaaaattagccgaaaaactcacactgaccgtgtttaaagtgacaggagaaaccaatacagatgatctttcgcctgcacaagatgcttggtcacgcccagatattccattgcacgcactggctatgcttaaaaatgaacgggagggtattgaacctgaccaagctggtgtagttggtccaatgaaacagattgaagcccttaaacaaaaaggttttccacttgtttatgttggcgatgttgtaggaacaggttcttcacgtaaatcggctacaaattcggtcttatggctcatgggaaatgacattccttacattcctaataaaagagctggaggtgtggtattaggcggtaagattgctcctatttttttcaatacgatggaagatgcaggctcattacccattgaagtggatgtaagccaattaaatatgggcgatgtaatcgacctctatccctatgagtgcaaaatttgtaagcatggcagtgacgaagtattagcccagtttagtcttaaaacgaatgtgcttcttgatgaagttcgtgcaggcggacgtattccattgattattggtcgaggtttgacacataaagcacgcatggcactaggattgccagaaagtgaagtgtttgttaaacctcaaatacaggctaaaacaacagtcggctacacacttgcacaaaaaatggttgggcgagcttgtggcgtggagggcatacgcccagggcagtattgcgaacctcgaatgacaagtgttggctcacaggataccacaggtccaatgacccgtgatgagcttaaagatctcgcttgtttaggtttctcagctgatttagtgatgcaatcattttgccacacggccgcgtaccctaaacctgtagatgttgtgacacatcataccttacctgatttcattatgaaccgaggcggtatttcactacgtccaggtgatggtgttattcactcttggcttaatcgaatgctattgcccgacaccgtaggtacaggtggcgactcacatacacgttttccgattggcatctcatttcctgcaggttcaggcttagttgcctttgcggctgcaacaggagtaatgccattagatatgccagagtctgttttagtccgttttaaaggcgaattgcaaccaggcattaccttacgagatctcgtacatgcaattccctattatgccattaaacaagggttattgacggtagaaaaagcgggtaagaaaaatatcttctcaggtcgcattttagaaattgagggattagagcaccttaaagttgaacaggcttttgaactttcagatgcctcagccgaacgttctgctgctgcttgtaccatcaaattaaatcaagaaccgatcatcgaatatcttcagtctaatatcatcttactaaaatacatgattgctgagggttacggcgacaaacgaacccttgaacgcagaattaaagccatggaagagtggctggcggtcccacaattattagaagcagacagcgatgctgaatatgccgctatcattgaaattgatttaaatgacatcaaagagcctattctttgtgccccaaatgaccctgatgatgctagaacactttccgaagtgcagagtcaacaagtcgatgaagtctttattggctcttgtatgacgaacataggtcatttccgtgccgcaggtaaattgcttaaccagcatcaaggcatgatcccaacacgtttatggattgctccaccaactaaaatggatgcaacactacttagtgaagagggctattacagcatttatggcaaaagtggagcaagaattgaaataccaggttgttcactttgtatgggaaatcaagctcgtgtagccgacggctcaaccgttgtttcaacctctacacgcaatttcccaaatcgcatgggtaaaggctcttttgtctatcttgcttctgcagagcttgcggcagtctgtgcattactaggacgcattcccacatggaaagagtatttagattatgtacaacgcctagaggcagataaaacggatacataccgctacatgaattttgaccaaattcaacgttatacccaaaaagcagataacctcatttttcaaacagcggtttgattttgcataaaatttacgataacagggaggacaaaatgcctaaactacacccgactttaactgcagaacttcaccttaatgatgggcgtaaaattccattgcccgtttatcagagtaacttaggttttgatgcaattggcgttgaggcattgcaaaagcaccaactctttacctacgatcaagggctaacatctactgcactatgccaatccagtatcacctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgcactatgccaatccagtatcacctacattgacggcgaacaaggtgtcttactgcaccgtggctatccgattgacgagcttgctttaaataaaacctatcttgatatcgcctatcttcttctaaatggagaactgcctacagaagaagaattggctgagttcaaaaaagagatctgttcacattacatggtaaatgaacaatttacccgcttgtttcaaggtttccgccgagattcgcacccaatggcggttatgtgtgcagcaagtagtgctttagccgcattctacaatgacatgctagacagtgatgacgaagcacatcgagaaaaaaccgccattcgcctcttagccaaaatgccaacccttgcagctatgtgttacaaatacaacatcggccgcccatttatgtatccgcagtatcacttatcctacgcaggcaacttcctacacatgatgtttgcaacaccttgtgaaccttatgtggttaaccctgtactagaacgagctatggatcgcatcttcacacttcacgcagaccacgaacaaaacgcttcaacatcaacagtaagaggcgttgcttcctctgggccaaacccatttgcttgtattgcggcagggattgcatcactgtgggggccagctcatggcggagcaaacgaagcctgtatcaaaatgctacaggagatcggcacggttgaccgtattcctgaatttatcgcaagagccaaagacaaaaatgatccatttcgtctaatgggatttggtcaccgagtatataaaaactacgatccaagggcaaaagttatgcgggaaacctgccacgaagtccttgcagaattaggaataacaacaccattacttgaagttgcaatggaactagaacgcattgccttaagcgatccttatttcattgaacgcaaactttatcctaatgttgatttctactcaggtattattctacaagccataggcattccaacttccatgtttactgttatttttgccttaggcagaacagtcgggtggattgcaaattggaaagaaatgtgcgaagagagcctcaaaattgtccgtccaagacaaatttatacggggtatcaagaaagacatattaaataataaaacgttgagataaatagttgctaagatcgtattggttcttagcaactatttttgattctatatgtagaaaggaaattaccctaaaattttattgagttcatcgcttatagattctacagattgagtaccatctaaacggtagtattgagtatttcctgcttcagcttccgtagtatagtacgctatcaatggtttagtctgtttatgataaatcgctaaacgttctagtacagtttctggtttatcatcctgacgaataattaggtcttcgccagttatatcatctttaccttctactttcggtggattatatacaacatgatatgtgcgaccagatggctgatgaactcgacgtccactcatacgatcaacgattacttcatcggccacatcaaactctaatacaaagtcgatttttacaccagcttcttttagtgcatctgcttgtggaatagtgcgaggaaaaccgtctagcaggaaaccatttgcacaatctggttgagaaattcggtctttaactaaggcaacggttaattcatctggaactaattttccctcgtccattaatgctttggcttgtttacctaactctgttccttccttaatggcagctcggaacatatcccctgttgaaatttgtggaataccaaatttcttcatcataaatagggcttgtgtacctttgcctgcaccaggtgctcctaataagataattttcatagtaagacctcttaaaataaaaatagtggagtagattagtaaccctattgattactgcttgagttgtgaattttattatgtaaatgctcacttgttaagtcagtttaaattaaagcgagctaaaaaataccactaaaatcaaaagcggtatcacatatttaacatagttaaaccacaaattcgttaatgttttccctgcccctaattcttccttcgcttcatcttttaagacaaaaccaacgaaaattgcactgccaagagcggtgagaataaataaaatgttaccgctgatatagtcaaaggcatcaaaaatacttttgcctataatggtgatatctttccatacattatcacctaaaacagatggtacattaccaaaaatggaaatcagggtaagtgtccagaaaatcgctgctttacggctcattttagttttttcttgtaaagcagtgatgatcacttcatagatggttaatgaggtcgtcaatgctgcgaccactaataatccaaagaaaataatagcaaagatcgtaccgccccacatattagagaagacaatcggtaggctttggaagacgagtgttgggcctgaatttggggcaatgccaaagctaaagagtgatgggaagatcataaagcctgccatgactgcaattaccgtatttagtacccctgtgattgtcgcagttctcactagattttcttttttatctaagtagctagaaagggtaattaatacgccgaaacctaagctaagtgcaaagaagacttgccctaatacaaagacaaacaattgcggtgtaatttttgagaaatcaggcattaaatagaatttaatcccttctgctgcccctggtaaagtgacattacggatcaccataataatcaagaagataaagagtatcggcataagatatttaactgaacgctcaatgccatcaacaatgcctttgactaagatgaagtagtttactaatacaaacaagccagtataagccaaaatggtaactgggctgttaaaaatactctctttaaaataagtagatgtagtttctacggtaacaggtgatgatagatctaaaccgcccgttacaagactgccgatatagtttaatacccaaccaccaagcaccatatagtaagcaaggataccaaaagatcctaataatcccatataacccaagattttccacgcagggtgaatggctttaccattcgcttttcccgtaaaggcatcaatggcatttactcgcatacggcgaccaatcacattttcaaccaagatcatcggaataccgatcatgatcattgcgatacaaaatagcgagacataagctccgccaccattttcaccgactaaataagggaaacgccacgttgcaccaaaaccaacggttgcacctgctacggtcataatatatgccaatcgatttgaccacgattggcgttcttggggttgtgtattcatattttttcctactacatacaaaaggaagttaagagaacagagcaaaaagttcatcgactttaattcgagagtcaatggattgaccgatgtgacgctgaactttcagttttttgatttttgctccacggtagatttgccgagtaaactcggtatcgtgatttgaaattaggacagggattttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaggcggatcgcaatagaccgcataatcatcaggattatctaatagatattgaaagacttgatgaaaatcggcacagataaataccgctttctgagctttttccgcaaaaaagcgtaactctttttcagggaaataatgggttttataatcgccaaatggcacgttgaactcatttttttggttatagcgacataaaccattaaaaccaaaacggttgagataaagaaacagtgctgaacgacgtagcagatcttggcaagcattaaattccttacgtcgctcataataaaattttgccgtatttgcttgtggatcattaaacaaggcttgcgattgatggatatagctttccacatcagctttaatcacattaaagagattaatcagatcagggttaatgtcagcaagaatatagcgttcaaaatgtgtattaagaaaaactgagccagccccaacaaaaggctctactaggcaagccttttggggtaggtgccgattaatttcatcggtcaggcgaaatttcccacctgcccattttaaaaaggctcgctgtttcattgttaaaacttaggattgagtaaatcgacggatagcatctaacacttgagtttcggtcgcttgagcggtgacataagctgtgccaagtgattttaataaaatcagacgcaactgaccgcttagtacttttttatctcgccacatataaggcagatattcttcaggcatcattccatctggtgaaatggttggcaaggttgcacgagcaatcaatttttctaaacgagccacatcttgttctgtaagatcgcctagaatatgcgacaaggcagctgcttcaagcataccgactgcaaccgcttccccgtgtaaccagttaccgtagccaagatatgcttcaatcgcgtgcccaaaggtgtgacctaaatttaacaaagcacggtcgcctttttctgtttcatcgcgagccactacatcggctttcagttggcaacaacgttgaatacaatactctaatgcagactgttcaagggcaacgagatcgtcaatatgctgttcaagccattcaaaaaattgagtatcaaaaattgcaccatatttgatcacttccgctaagcctgcactcacttcacgtttaggcaaggtttttaaggtatttgtatcaacaatgactgaaatcggctgataaaacgctccaatcatatttttgccaagcgggtggtttaccgccgtttttcccccaacggaagagtccacttgagctaataaggtggttggaatttgaataaaacggataccacgttgataagacgcagcagcatagccagccacatcgccaattacaccaccacctaacgcaattaataccgaatcacgattgtgatttttttcaagtaatgcggtaaaaataagattgagtgagtcaaggtttttatattgctctccatcgggaattaaaaccgaatcaactttacaaccgatagctgttagcgtttgttctactgttgcaagataatgggaagcaaccgttggattagagacgatcatcaccttatcccctgattttaacgggtgataactcatcggatccgttaataaccctgcccctattgcgataggatagcgacgttcttttaattccacattaacttgcaacatatagacttccctgattactgtaaattatcaatcatatcaatgatttgcgttgcgactacttttgcactttgttcatcagtttgcaaaataatgtccgcaatttcttcgtaaagcggattacgaatttttgccaattcaactaacgtttgatatggatcttccgtttgtaataacggacgttttttatcacgttgagtacgttcaaactgtttatccaccgtagtttcaagataaaccacaataccacgagctgaaagcacattgcggttatctttagacaacaccgaaccaccgcccgtcgaaagcacaagaccttgagattgtgtcagctcattaatgatacgctcttcacgcttacggaaaccagcttcaccttcaatatcgaagatccaatcaatatctgccccagcacgctcttcaatcacagcgtctgagtctaaaaaatccatatttaacatttgtgctaattgacgaccaatcgtgcttttacctgcacccatagggccaattagaaagatattacgtttttctgccattatttgttctataaataaaaatagagtgaaaaattgatttgtgaatttttagaaaaaacagaccgcttgcacatacaagcggtctgttttatgttgaattttgtaaaagtgattaaaattaaaacacttatcttataaatttaccacaaatcgcccaaaataaagatgggcggtattatctcaataaatcgtcctacttttcaactggaacaaagagaattatcgaattttagaataattctttactgattttttcagttccttcaggatttgtacctagaggttgttcaagtgccttctctacaatataacgtttcttaggttcagttcctttaatgaaatattcgctcatatttccccctaatagaccgcttgtaggctcaatttgtaattctatgatattaggtggtaactgttcttttcgctcttctttatccgaaagagccactttcatatacttaatccacgccggcaacgctgtttgagcgccagcctcaccacgtcccaattcacgtttattatcatcaaaaccaacataaactgtcgtcacgaggtttgaaccaaagcctgcgtaccaagcgatttttgcgttatttgtagtccctgtttttcctccaatatcactgcgcttgatctcatttgccacacgccagcttgtccctttccagccttgactagcttcacctgtaatggctgtttttaatgcacttcgcattaagaacgcaatttccccactgataacccttggggcataatgcacttctcgattaacagctatggcatctgccatcaagcttggggcattttgtttggttttagtggcaatatccagttcaggaataacatcactttcatcatctttaggaattacagtttcttctgtggtttcctttactttgacaaaatcaaaataggttggctctggataaatgactggcttatcatcacactctaaacaggcaattgcagggtttgctttaaagagttcattgcctgtactatctaaaatacgaccaatgatataaggttcaatcaaatagccaccattatcaaacacagcatatcccctagccatttctaacggcgtgaaggacgctgcccctaatgccaatgcttctgtcgcttgatattgatctttttggaagccaaagcgttgtaagtaatccgctacatactctacgccagccatctgaactgtacgcaccatcatcacatttttcgacttacccaagcctactcgcaaacgtaacggaccttcatacacattcggtgaatttttcggtgtccacggtttttgtcctgcttttgtaatagtaataggcgtgtcgcttagagtggttgaaaggctcaatcctttatttaatgctgcagcatagataaaaggtttaatcgaagaacctacttgcactaaagattgtgttgcacggttaaaacggctttgttcaaaactgaaaccgcccacaatcgcttctatcgccccattatcactatttagtgaaaccagtgcagagtttacatctggaatttgccctaattcccattcacccttactattttgatgcacccaaatttgttcaccaacattgatcacgtcttttacttgagtaggtgctttaccttgggcggagtcattgataaattttcttgcccaacgcattccagacattttaagctcaacacgctcccctgttggcaacatcacattcgctttatcttttgaaattgccaatactgccgcactcgtaaatggctcagagcttggcaatttgcttaggtgatcgatgatcttttcttcgtcccacgctttctctttagggttccacagtttctcagctccacgccagccgtgacggcggtcgtagtcaatcaagttattgcgtagtgcatcttgtgcttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttggtcagctgataacactgttgcaaacacttggaaacctttggtgtaagcgacttcttcaccataacgttttaccatttcttgacggatcatttctgtcacatagtcggcgcgaaattctaacgcagcaccgtaatatttggctttaatcggttctgctttagcctgttcatactgagctttggtgatttttccgacttctaacatacgcccaagcactacattacggcgtgcttctgctcgtttaagcgagaaaagagggttcatcgtggaaggggcttttggtagccctgcaatgatcgccatttccgataaggttaattcttctagctttttaccaaaataggttttagccgcagccaccaccccataagagcgataccccaagtaaattttattaagatataactctaaaatctcattcttagacagattttcttcaatttctaacgccaaaattacttcttttaatttacgctcaagtttgcgttctggcgaaaggaaaaagttgcgcgctaactgttgcgtaatggtactcgccccttgcgtatccccttggcttgaacgccaaacggcacgcataatgcctttaggatcgatccccttatgttcataaaaacgggtatcttctgtcgcaataatcgcatcaattaaggtttgcggaatatcggcaagtttcacaggaatacggcgttgctccccgacttccccaatgagtttaccgtcagcggtaaaaatctgcataggttgttgaagttcaacggtttttaggcttgctacatcaggtaaatcttcttttaaatgaacataaagaaaacctacagcaactagacccacaattattagtgtaagtaaagcactaaatatgatttttacgatcttcatcgaaaaattctcttttgctaaatgacgaaaggataattctaggtcaagataacctaaatccgaaaactgccccctgcttatacatcagtggggtagaaacgagtaattatagttttaattgacctcataatctattttttattcgagggaaatatgggtaaattctttcaatttcgtacaacaccgcaactcaaacctattcaagttggctttttctggcaagaaaataccgcttgtatcgtctattttgaacaagaacaacctcacaccttttacttttcaagcaaagtagaagcggatagtttcctacaacaatttccctttaactatcagcttattcaaggcatttctcatcagcatatttggcgaaaaaccttgatactgccagagctacattcccatttaaaacaagctgagcaaatcattcgtgtactcaaacagagcctacctttagctttatctgaagtaaacattgattaccacattacccctttagccgaaagccacctttgccagcttaatctatatgctctaagaaaaagcaacagctttgacccaacggctattttagattgcgaactctactgcctactacgagcggtaggatttctgacaaaaataacggaaacgcaaattcttgaacacagtttccacattcaagacaaatttattcactttcaaaatcaacgaattatcgtcgaaaagcagaataatagcaccaaaccaatcattgaagtggacggcttgccccaagctcaacactttccccatttttatccttatcttattgcattaggagcgagcttatggaatggcaaggtatcaatctaaacggctatcgccaacagcaatggttgaaacagtcgcaaaaaaacctcaagcatctcaccgcttgcattgtgattagcacactactggcgttacttatcagttggcaaaatcaacagcaacaacatcaatttcacactttggctcaacagcgacaacaaagccaagagcaacaaaccgcattaagccagcagattgaacaactgactttgcaatcacaaaataaaagcacacaaagcctagagaacagacagattaccgcatttttgaattatctgttaggcattcaattatcagggattattgagatagcccaactataccaagcagaaaataccgtctttaaactcaaaggcaaggtgtctagccctactcaatttagccagcttgaacaacaattaaaagcaatgaattacatttatcaaatagaacaatttgaaacgcgtgaaaaaagcgagattgaatttagcctacatattgatttaaaggaaaaagaatgaaattgtccttagccaagtattatttaatgccagaacatccattatatcgtggcttatattatttaaaccaaaataaaggatttattctatcgggaatatttttattgattgtggcatttccagtaggaaattatttttatcttaatcagaaaatagaacaacaacaaaaacagctcactgaagttaaacagattattgagcataaacagcaacaattaaaattattacaacaacgctatcaacttgctcaagataaaagtgaattattaaccaaaataaatcaacaaattcagctgattttagataaaaatagcgtagaaattgacagtattcaatggaatatggaagaaagaaaaatctatttattaattagccaatctacacaaaagatatttaatgtgattgctgagcttaatcaattaacaacagttaaatttcaggaaattcatttaactaaaaaaacaaaacagaaatatattcaactcaatgccactttactttttcaagctgacacaggagaaccgtaatgcgattatgctttttctattttgtctttctaagtgctgttactatggcagatcctttttatgccaaggaaaatgcccaagatcagccacaaacggcaaaagatcaaaacaaaacgaccgcttgtacgccaacagagaaggtgaacgaaattcacctcaccacagattttgataaattacagcttatcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcaccacagattttgataaattacagcttatcggcattattcagatcgacgataaaatccgagcgatttttatagatgataaaaaacagcttatagatttataccctgacgactatttaagccattcctttattcaaattaaagaaattaattttaaatctgttagttatattaattggcaaaaaacagaaaattgccaatcccctaaattgtttacttcaaaattttaggagtatattatgcgttatttattcctgctattctttgctacttttcctgtattagcaaaccaacaaatttcactttcgataagaaatgccccaacggcagagattattagttatttggcggaggaaactggaaagaatattacaatttcggatgaaattaaagatacaaaaaatttcagagtagaaaaaagccattttgatgagatattaaatagtttaatcaaaacacatcaattaaatttaaaaaaagaaaatggcatttactatattcatcaagcccaagaacataaacaacatactacggcacaattagttaatgctctgcctaaattaatcaccaaaacaatcaagttacactattccaaagcctctgaagtaatagagtctttgacaaaagggcaaggcaacttgctatcagagaatggttatcttcattttgatgatcgcagtaatagtattatcgtcaaagacagtgccgcctcagttaaaaactttactcaacttatcgaaagcctagataaaccaacggaacaaattgcaattgaagcccgaattgtcacgatcagcagtgaacatttacaacaacttggcgtgcgttggggcttattttcccctaacgaaaatcactacaaattggcaggaaacttagagggcaacggattaactaccaacaacttaaacgtaaattttccagtaaatccgtccgcttccgttgccttacaaattgccgctatcaacagccgtgtacttcatttagaactcaccgcattagagagcgaaaataacattgagatcattgcaagccctcgcttactcacaacagataaaaaaccagcgagtatcaaacaaggtacagagattccttatgcaatgtacagtaagaaaaaggaaatcaccgatattgaatttcgtgaagcggttttggggctagaagtcacgccacatatttctaaacaaaatcagattttgttagatcttgccattagccaaaattcgccaaataaccagatgaacaatatgatggcaacgattgataaacaagaaattaatacacaagtccttgctaaacacggcgaaaccatcgtattaggcggtatttttcaacatctgatcgccaaaggcgaagataaagtcccgctgttaggcagtatccccgtgattaaacgcttatttagccaaaaccgagataaaatctctaaacgggagctggttatttttgttacgccttatattgtaaaatctgaaaaaatgggagcggaaaagcagaaataacttcacctttattttgcgggaaaaggctacaatgtgttagaattgccgactatttttatttcgataaattgaggttttatgaaagtttctccccgtcgtcgtgcgagagaatgtgcggtgcaagcactttattcttggtacatttcgcaaaatagcattgaacaagttgaattagcctttgtgaccgatcaagatatgcaaggcgtagatatgccttatttccgtaaattgttacgcggtacggtagaaaatgtagatgttattgatgatattcttcgtccatatttagatcgtgcagataatgaattagatccgattgagcgtactatcttacgtttagctggttatgaactaaaatttgaattagatgtgccttacaaagtggcaattaatgaagcgattgaagtggcaaaagtattcggttctgacgatagccacaaatatgtcaatggcgtattagataaattagcccctgcgttgaaccgcaaataaggattacaatgggcgagtttgatttgataaagcactattttagtcgtgacaagcggttagatcgccacgatattttactttccgtgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttagtgcttggtacacattttcttcctacgatttcccctgctgatttagcttataagtccgttgcggttaatctgagcgatctcgcagcaatgggggcaaaacccgcttgggtttccttggcattaaccttatccgacgttgatcatcaatggcttgatagctttagccaatcactttttgctattttagccgagcatcaaaccgctttaatcggcggtgataccaccaaaggtcacttggcgatcaccttgaccgcacaaggctttctgcctaaaggcaaaggattattccgccataaagcacaggtgggggatcttatctatgtttcagggcatttaggcgatagctcggcagggttagccctgttgctcaatccgccagccacattgaccgacgctcaacactacttaattcaacgccatttacgcccaacacctagagtgacattaggacagtgtttgctcaactatgcacaatgtgcgattgatatttccgatggattgttagcagatttagggcatattttagagcgaagtggttgcggagcggaaattaatgtggataagttaccgctttcagcaccactgttacaaacttattcacaagaacaggcagaacaatttgctttaacgggtggggaagattacgaactctgttttaccgtatcggaagacaatcgttctgcaatggaacaagccgttgcagatttaggcatttcttgccattgtatcggtaaaatcaccgaaacaagcggtcgtttaaccttactaaaacacggcactgtttatccacagcctaatcaagttggctttgatcattttaattaacaatgaagataaatttaaaaaatcctattcattttctcgcattcggctttggttcagggctaatcaaacctgcccctggtacttggggaactttggctggtttagggggggcgatcttgttgtggcacatcacagaaagcacactcttttttgtgttactgagcttgatcacttttgttgctgggtgctacatctgcgacaaaaccagtcacgatcttggcgtacacgatgatgggcggatcgtctgggacgagatcgttgcggtgtttgtgatcttcggttttctgcctgaacacaactggctctattatctgctgacctttgtcactttccgcttgtttgatattctcaaaccctaccctatccgctattttgatgaacatctgcaaggcggattaggcattatgtttgatgatattttagcggcaatctactcgattattactctctatttgatctcttggtgcatttaaaatgtggacaatttttttcgtacaattactgggcttaattagccctggtcctgattttttctatgtcagccgtaaagcaatggcagatactcgccgaaatgcgattttaggtgctatcggtatctctatcggtgttgcattttgggcattgctcactttgtttggcttggcatttctcaataaacatttcccttcatttcaatttgtgctgatgatttgtggcggaagctatcttgcttatagcggcattcaaatggtgcaaatcacgaaaaatgcggaaattggctcggcaacatcgacatcacaagcaacttcaaccgttaaagaaattctaaaaggattaatgattaaccttgccaaccctaaaattgtggtatttttcagcagtgtgttagccggttacgttgctaatctctctgcattagcggacttacttgcggtacttgccattttagtgggcagtgcagtggtttatttctggcttgtcgctttgctattttctcgaccagctattcgctatttttatgccaaatataaccgctatctagataattttgctggggcagtgtttattttatttggggggaaattggtgtatgagggggtatttagcctatggatattctcctaaatttgagaggtagacaaaggcatcaacaggtatgtcccataaaaatgctgtaaataagatataatgtatcaatgtgttagttattcaccgaactatatgaggatttgccgtttagtattcttatacatagtggaaatttccctaagtataaaacttcatagcacgctaggtaaaattaattacattaatacttaattcctacttgaaaagtcaggaataaagcactatcttgtgcacgtcttaacgctttagatgttatagaagcgtttcttttttattttagttaaggaaaaattatgagtagagtaattcatacaactgacgcatcttttgaacaagatgtattaaaatcggatgtcccagtattattagatttttgggctccttggtgtggtccttgccgagcaattggtccagtattagatgatttagccataaatcttggaaataaggctcgtattgtgaagatgaatgttgatgaaaatcagcagattccagcagaatttggtgttcgtagtattccatttttattgatttttaaaaatggagaagtcgtagctcaacaagtaggggctcaaaatttgccagcatttttagaacatctatcttagtttctatattaaaaacccctatattttagagtctttctgagtatagctattaacatctcacggttagattgctctaaccgtgagattaatagcagacattaaaaaatcaaatcattactgtataagagggataattaattctcctcaataaggttgcagtttctttaatgtcctatgcgatatttactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactgggtttgatggtgatgaagagtaatcatttataggtggggattcccccaccattatgagaaatgaaaagccccaaatcgaaaggtttggggggggtgttttatctttgggagagtagcttagtacttaatcttgccacggcacataactgttgtgcatcatctcgaatttctatttgccacacttggctctctttgcctaaatgtaacggtgttgctctgcccgtggcttttccgctttttatcgcttttaaatggctgatattcaattctgtgccgacagggatttgattttcttcacaacaaagtaatgcagctgcagagcctaaggtttccgctaaagtcgcagaaataccgccgtgtaataagccgaatggctgtgttgtgcgatgatcgacaggtacggtcgcttctagactatcgttttgttgagcggtaaattcaatgcctaaatgcgaaatggcagagtgttggcagagttgattaagttgctcaatcgttgtgttttttttccaaatcatttttattttccgtatatagataaaacaaaagcctgttcaaataaacaggctttatgtataatttttcccaatgttttattgtttaaacataataaaacagaggcggatctgcgaaaaatcagtccgccagtaagcacctagcgggctgttttagtagatctttacgtttaatgttatccgtggagataaaaacaatgaaacgcattcttttgtggttaattgttattctgctatgcctgttacttaagggtagtgcgggctaagcagtgaaaccgagcaggaacggtgaccgccgttcctgtttttattttatgcctattttttatctaggtcaaatcacttccaacaacgcttgcacagggtgtttgagtagctgatgttccattcgtttcacttggctacggcaagagtaaccggtggcaaggcaacgggataaggttttgccttgtaacttcacttgccaggattgtgcgtaaatctcttttgacattgcaaggtgtttggtttcgtgcccgaatgtgcctgccattccgcaacagccgatattttccgccgttaaggtttcgccgaaatgggcgaaaatctgttgccactctttcaagctgtttggcagcgaggtgctttcggtacagtgtgcaaataagtgccacggtaagcggtcggtttcagctgattttttgcaatggtcgagagtgccgtttttcagttgagccaacagccattcgtgagccagcaacaccttaaattcgccacagtcgtcttttaaaatttggcggtattcttcacggtaaatcaaggttaaggcaggatcaacgccaaccattgcaatgcctaatttggcaacacggtttaacaattcggcttgtgtgcgagcggtgttggcaaacttgtgcaaaaagcctttgatatgttgtgctttgcctgttgggttgaacggcaacacaatcgctttgaagccaagtttttgggcgagctgaacaaaatccgccaccactttggcatcataataagaggtgaacggatcttgcaccacaaggacatatttgcaaatttctgtgtctagttgaccgcttgtcgccagctgttccagctcttctaaggttttgccttgatagccgatttcaattaactgttgctgtaaggtcggcacggataacgctggcagatcgaccattccgatggttttacttgcaacggtttcagccagtttgttggcactgaaaaagttaaacaacttcggctgttttgccattatcggtgcgataaattcgaggttcgccaccacataatctttcagcggacgcagataacggcggtgatagagttcgttaaattgtgagcggaacgtcggcacatcaatttttatcgggcattggctggcacaggctttacaagcaaggcaagtatccattgctgatttcacttcgtgggagaaatcatactcttgtgattttcgccactgattgcggattttcttcgcaaaatcgactaatttcgccgatgtttgctgtttttcaaagatcaactcatcaggggaaacattttgttccgccagtaaacgtagccattcacgcactaaagttgctcttcctttcggtgaaaataggcggttgcccgacactttcattgacggacacattgtactgtgtacatcaaaattgaagcacaaaccgttgccgttgcaattcattgcccctttaaaggcttctcgcacttgaataggaatttgtctgtctagatcggcacgcatttgcgaatcaatcgaataaaggctggcttggctatctaacggcgtacagattttacctgggttcaagcggttttgcggatcgaaaagctgtttgatataacgcaactctttccataaggtttcaccaaagaaccgctcaccataggcagaacgcatacctttgccgtgttcgccccaaatcaaaccgccgtattttgcagtcaattcaaccacttggtcggagattgccttgaatttggcaacttgtgatttgtcgcataaatcaagggcaggacgaacgtgcaacacccctgcatcgacgtgtccgaacataccgtaatctaagccgtgatcgtcgagcagttggcgaaattccacaatataatctgccaaatgttcaggcggtacgcaggtatcttccacgaaagcgatcggttttgcccaaccttttgcgttgcctagcaaaccgaccgcttttttccgcattgcataaattttttcaatcgaagccaaatcgttgcaaagttggtagccgatgataccgcttgtgccgtcttggattttttcatctagagcttggcacagcttggcaatccgcgcttcattctgagccttatcatttgaagcatattcaacaatgttaatccccaaaatcggattgtgttcatcttcagtgagcagatccgacaccgaatgccacacaatatcttgtttggcaaggttcagcactttggagtccaccgtttcaaccgatagggcttgggcttgcaacataaaaggggcggaacgtaacgccgcatcaaaggaattatatttaatgttaatcagcgttcggtattcaggaagcggaagaagattgagcttagcttcgcaaataaaggcaagagaaccttcggagccagtgagaatacgggttaaattaaattcggagagatcgtcgttaaatacatttttcagatcataacccgtcaaaaagcggttcagttgcggtagttctttcagcacggtcgggcgtaacgcttggcaacgttggaagatcgcgctatgcaattttttgccattcgccgtgagattaagttgatcgacatttgcaaaaaaatcatcggttttgaccgcttgtgtttccaaaatatcgccgttcatcaacaccgctttaatcgccaaaatatgatcggaagtcttgccgtattgcaacgaaccttgccccgatgcgtctgtgttgatcattccgcctaaggttgctcggttgctggttgaaagctcaggggaaaagaatagcccgtgcggtttgagaaattgattaagctgatctttcaccacgccagcttgcactcgcacccaacgctcttgtacattcagttccaaaatttgagttaaatgacgagagagatcaacaatgatattgttgttcagcgattgcccgttcgtgccagtaccgccaccacgcggggtaaaggttaaggcttggaatgcggttttttgtgccagtttggttaaaatcactacatcagcaacggatttcggaaacaaaatcgctcggggcagttgctgatagacgctgttgtcggtggcaagagaaaggcgatcagcatagtttgacgcaatatcaccactgaaatgttgctgtttgagttcagctaaatatttctgaacaagcggattaagttgaggtatgtttgcaaggcgtgggatcatagttttttaatctgttaaaattttaacgagatcttagcaagattttcatttaatgaaaattactacaaaaaaattggcaaagcatttaaaaagttgcaatttattacatttacttacatttccttgagtgcttataaattgatttcttttatattaatgggataatagttgcattcttgcctcgttctttaagaaagaaaagacaggaatgtaagaaatttcagcctcgacacggcttctttgaaaaagttcgcttgtatttcggattttttttagtaaaatgtaggcgaaatttcgactttcttttcgtattgaagaatagaaagcgtagttaaagccttagcgtaatgattacgctaagaattttgtttaattagatgacgataatagaggatcatcaaaatgaaaaaatctttaattgcattagcagtatcaggtttagcagttgcttctgtagctcaagctgctccacaagctaacactttctatgtaggtgctaaagctggttgggcaacattccacaatgatattaatcaaattgactctaagtatgctaatgatgcacgttatgatgctactaatttaaaatatggcattagccgtaactctgtaacttacggtgtgtttggtggttaccaaattattgacaacttagcagttgaattaggttacgattatttcggtcgtgttcgtggtaacaaacaagaattccgtgcattcaaacactctgcacacggtacacacttaagcttaaaaccaagctatgaagtattaaacggtttagacgtttacggtaaagttggtgctgcattagttcgtaatgattacaaacgttactccacaacaagagaaccagttaaatcgcataacttaaaaacttcattaatcgttggtgcaggtgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctccaccttaatattcaactcttcaacattgccgtcatactcacccctcaaatacaaactcaccgtagcaatcgacacccctaatttatttgcaacctctttttgcccaattttggtgcgttccatataatcttttaatagttggtttttcatcgcttatttcctataatcaaagtctcttttttcatcaacaggcttcgttatgcttaaaactccacctgaccttaataaactcactaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacagatcagggcgaagctcagatttggctacttcgccattcgtgacttcttcaattttcttagcaagataagcaggcattggcgaatatcctgtttcaacttgtcgtaaataagatttagaaataccaagcttttttgcaaaatcagctttgaagccacgaggacgatctgacaaataactagttaagtccatcatcactcctgttaagtaaaaattagatttagtttagatttaactaaatacaaagtcaagtaaagtttattttttgcttatttaggaaatactaaatagaatgatttaaaaatgaaaagtgaggttagttatgattaaaaatatgactctgccagagatccgtagaaaaaaacttacagaatggttcagtacgagagatattccagaaaaggaaaaaagctacatatcacaattaaaatcaggaaaatcatcttttggtgagcgtgcagcaagaagattagaaaatgagtatggaatgcctagcttttatttagactatgatgaagaaacagaaagtgctattgtgtctgcaatatccattcaagaaacacattctcatcaatatcctattcatctaattaactttaaagctaaggctggtgaaacaggttttatcaatactaactatcccgaaattattcaatctatctatttctccttagatggtttgcttgaaattgtagggagaaaatcaagcaatggcattgagatgatcactattccaactgatagcatggctccaacaataaacaaaggtgatgtcgtttttattgataccacaatcaattattacgataacgaaggtgtgtatatttttgccattgatgatgaagtttatattaaaagactacaaaaaattccagggggcgtttatagagctttatcagacaacaagacttacgagccttttgatataaagagagaaatcttagatactgcaattatccttgggaaatttatccgagtattgccaataaaccctaaagatttgtagctattggcgtggcagttgagcataggagctacttgtagcaactattgaattttattgagtaaataggcgagttcgccataattaaaactggagaatggtatggttcctaatgatgtaataatcgtacaagagacagaaattcgggttacagaacgaaatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaactctgcccaatttttgataatttccgcccaaacaggacatatagacgttaacttactcaaatgatttcgcattgctggagcgacagtcagtaattgcatacaacgccttaaatccgcaggatcttgtggataacatactcgttttggtaccacatcaaagccaactacaaacgccattgttttactacttaaccctgtctcaccatcagctaaccattcaattatttgttgttgcattttgttcattttattttccctgcaatgccaaaaactcactttctttaatttcgactaagtaatctggtacttttgggaaatcatcaagatcacaatcttccccttttacagggatttttgcgatatattgcccattagcaataccagctaccgcaatataaagatttgtcccataactaacccaacaggataaaccaagttgttttaagctataattggaaaaatcaggagcttcattaagaatttctcgacattgtcgtaattttttatctaactccttacctgctttgtaacgacgatcaggttttatgacatttttccctttataccgctcaattttgtaacctttcatacttttcacatcgtttaatgcgggactatcgtcatcgcaaacaatcccatacatagatgtttcgctaccacaccagccattataaaaaggtattgttgcaaaaatttcctcaagtttttgattgcgtacttctcgcaagttttgccagtttttgtcaatcgtcttaagtggttctactgacatatcacccttaaaaaatctaaactcaacattactcatcattttctcctactaactcttccgcaacataggacggcaccattacttctttaatcttatacaacataacgccgtcagctccttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcaccgattgtgggggcagagagtaaagatctgtgtcgttcaatccgtaatcttggcaaagttgatccgattttagtgtcagatacttcacaacttggcgaagtgttagatcaaattattcaagatggtgatttaattttggcacaaggtgcgggcaacgtgagcaagctttcgcgtgatttagcggaaagttggaaggcataaagaagatttaaaacaagcgataagatttcgagaaattttcgctattgtgtaattgtacaaaataatgtgtaggggcaaatcacatttgccccaaataatcatagtaacatcagggcgaatgtaattctctcctacggtaaatccgaaaatttgcaataatttcaatgaattaactgtagggacacactgtgtgtccgttgttaaaatgggatatggtttattttgcggacacacgcagtgtgtccctacaattccccataataatgtaaaattcttgcaataaatgaccgcttgtaaaacataaataaggtaaaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcccgcaggacctgttggacccattgcacctgctggaccttgatcacccttagcacctgctggacccgcaggaccaactggaccagtttcacctcttagtccctgatcacctttaggacccctaggtcctgctggacctgtttgtcctgttgcacccgcaggaccaactggacccgctttcccttccggtccttgtggacccattggacctggtgctcctgtttctcctcgctcaccccgaggacctgctggacctgcttcacctttcggaccagcttcacctctatcgcccttaggaccagctactcctggagcccctgctggacccgcaggacctgctggacctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttgctcctgttgcaacggcggctttttgcaaagtcggtaataagttcattgccgtatctgcggacatcgcccctgatgccaacaatgtatctaaggaattaagagcatcttcttttgttccaccgcctacggtgacagctttttctaccgccttaaatagctcttcttttcctgcaattcttccttgaacatcacgatctgaatatgctgtatttgctaccattgctaatcgtttatcaaaattcatttgattacgagcaggctctcgcataaccatcgccccagctgcaacaccagccccaacgctcatcaaaccacgcccaacatttgcagccttatctccaaaactagacttaccaagctccgcatttaactctttgatacgttgtttcgtttgctcagaggcacgacgtaactcattttgagaggccacgcccgaccgcttcaactgctcataagctgcacgggtttgcctaatttcctgctgtatcgcattttctgaacgaatacctaacgtttctctcgctcttgcaagatctgcagcactttttcttgcttctcggtaagcctgctcaatacgtttatttgatgattgcgttgccgtagcgactttctctgttgcattcacttgagtctgactgctacgaaccgctgcttgctctgcatccttaaaggctttttctgcttcttttccgaccttactaattacttggcttgcattatcttttgcacttagctcaagttgcactttcatatctttagccatggtaaactctttttaaattggatttaaacctataaaaaaggggctttacgccccaatttttccacgtcgagtaaacacaaaactttcgtgtttaacattattgctagggctatctgtcgcttgcttaggctgttttatgccttcaaactccaaataactctcaatccaagccgacaactcaatcagcgacatttgccacaccttatcagcaggaattgcaaatttcgcaaacaaaatcaccgcttggcgatattgtttaaaggcttccgctacgccaaaccgtcctgacggttgcttaggttgtctaggctcgccccatttccgataggcttttttttaagcatcaatgttgcctcaagcagttgccaataatcatccgtagctaaatgctcaaataaaaattgtgcatcaacgatttctgcaggaataccgtcaaaactgacctgctgagaaagataagccatatccactaaggttttctctttgtgactagcattctcttcgtcaatacccaatgcatcaatcatctcaagggctgagcattgcccgcccatagtaagcaaacgcacatttgccgtcttatataacctaccaagatactcaatccctaaaccaagctcaattttcattactcaacaacctcacgcaacgcacctagttgaatatcaatttgcgattcattgtctaccgtataggaagcacccacctcaatggtaaagcaccccaaataagatgttcgtttttccgcattatttaacgggtatttggtaagtttggcatctttgatatttttccaatcaatcaccgtaccatctttaggttctaccgcagtaatagataacgtgatctcttcaataccttgagcataccccttagctcgcccagcgctattcattgttttaacgaccttacgccctgtttgaattttgacatctaacttcgtaatatcaatttcaaccccatcaacttcaaggacacaagaaccttcaaagacttcagccataatctactcctataataacaatgtgattttattgcggataacgtgcaagccatttacaacatctgcaggaatatccaagtccaaatacgttgggtcttgggcattacgctcaatcaccaagcgagatttccagttatctacattctcaataatctccaactgctccaaacgataaagcacatcaaggatttctgagcgaactttgcgaataacacgctgtgtatttttagctctagggaaacgtaaacgttgacgagtttgaattgccttacgcacataatctaaagtacgaatagtagttaaatccaaataacttggatcgtctgtattcgtcactgattttgtataagtcgtaatagcacggctaatctgaacacgattcactacaacctcaagcgggcttaacccattaaataaggcttggtttacctcactaaataacggcttctgcgaatcgtctaccaaacttaaccccttgacctcaagcgtattaagaggcttcgcaggatcttcctcacctgcaatcacagccccataacctgctgcaatcatcgcatttgtttccgtacaacccttgtaccacgcaatagagatacgttcagaatttaaacgagaagataacgttgttcctgtcgcaaaagtaccacgccagcccattacaccaatccctgctttatcctcaatcgggtcgctcatcaattccaaatgctggcgtagtgccgttgcattttcttcatctgaaaatggcgaaataatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcggctgctggcaccagacttgccctccaatggatcctcgttaagggatttagattgtactcattccaattacaagacccgaatgggccctgtatcgttatttattgtcactacctccctgaattaggattgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgtgtcgccggcacgagggccgtgcgatccgtcaagttatcatgaatcatcggatcagcgagcagagcccgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttcccatttatcccaaagcaccatattgtcaggcatttttaaaacagctttaaaatgggcggtattccacgctttactggcaagagtgcgattaagtacgctgtcgtaatgcaaaatcgtaccgatataaattacatctaacttaccgtccgcagagcctaacggcagtacggttttcttgagccaattatgcaatttgtcacgctgttcagggttgcgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgaggcaagccgtgtcgctttaaatagctaatagactcaggtcttgctgaatccgcgcgtattacatactgctcaatgctggcaatacctttctgcaaaaatgtcgctgtatcatcaagctctaacccgactttgccagcctcatattcaatatacaattcatccttaaacacccagcatttaatcgctgcggttgggtcttgagcaaaaccgaaatccaacccgtgataaggcccctcaaaatcaggtaaaggcttaaactcaagttcctgatattttcctctaaagacttgagcctcgctttcttcaagataatccccctcccaaatccaacgataagtcgcatcatctaaacgggctttatctcttaagcgttcttgcttcaacacatcaggaaaccacggattgtcgctgtaattcatctcaacaatcgccatgctttcatcttgatactgtctaaagcgtaaatccgttgctgaacctttcttttcagggttccacgttaaccaaatttccgaaccgttttcacgcaccgtaggcagaagtttccgccatgccatttcactcacactttctgcttcatcaatccacgcaagtaaaatccgtgcttttgatttaatactgtcaagattgtgccgtaaacctgtaaaaatataggaaattcgaccgcactttgtgcgtacatatttctcaccaacctcaaagaaatcggtcagccacggttcactttgaatggcttgcttaatctcttctaatgatgaatcttccaacgagttcataaactcacgaccgcataaaatcacaccgctttcgccttgcattgcccgttgatatgcaacaaccgcagtcatcttggcaaaagtgcgtgtttttgccgaaccacgaccaccataagcaccacgataacgcacattctgctgtgtaaacaccggtatcagtttagggggaagattaagctgtattttcatttggtgccaccaactcaataaccgtagggcgaagtgagccgtcagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaactgcaaggattagatggaaaagcaagtaatgaattgatgtatgccattcgagatcatttgcgacttgaatataaatttgccagcggtttcattacagacagcaatgccattttattgggtgttacagcgagaactgtttggctttccgatgatacattaatcaaacaatttaatagccgtgaagggcaaaattttggtttagatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcgttttacccttgaacaatcggcacaaaaagcgggcgtgtcctttaatacggctcgccgttggaagaccgaagcggaaaaggcaggcgatgactgggataaggtgcgagatgctcaggttatggctggcggtgagatggacgaactctctcaaagtttgctgacggggtttattttgcaataccgtgccacgatggaagagttaaaagacaatcctgaattatcatcaaaagagaaagtcgctttgctttctgtgttggcagacagttttaccaaaatgaccgctgcgagtaagcgaattttacctgatgtgtcagagcttgcggttgcaatgaaaacggtagagcttttgggcgagtttattaaagaaaaacacccaaacttattcggcgattttcttgatgtgctgggtgattttggcgaagtggtcgataaagcgtttaggaaagggaaataatgtctgcattatgtttagtttgtgcctgtgttattgcttgccacgggcaaaatggctggggatggtttttgtttgccgctctactttttgggggtaaatgatgagaagtaaagagtttttgcaacaactttctgcgtatgcggaaagtatgcgagcgaaaatcgaagccgcttttgacgggtgggacgattcaccgcaggcggtggctgaacggcgtaaacaggtgtccgaccctgtaaatggtttggcattttttattaatcattattttccgcactatgttcgctccccgtctaaatctcaactgcaccgttatctttttgagcgactgccgaaagtgtttgcaagtgaaaaatcttgccttgaagcgattgctgctccccgtggtgaagcaaaatcaacgatagtcactcagctctctacactttggtgtttggttacgcagaaaaaacgctacgccctattagtgatggactctatcgaccaagcctatcctatgctagaagcgattaaatcagagcttgagtttaatcaacgtttacgcattgatttccctgaaattgcaggggctgggcgtgtttggcagtcggggacaatcattactcgggcaaatcagaaagtccaagtggcaggctcaggcaaaaaattgcgtggtttacgccacggggcttatcgtcctgatttggtgattttggacgatattgagaatgacgaacaggttcgcaaccctgaacagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgggaagcctaccacgagaaattaactcagtttgtctataaaaccaacctctttatgaagccgattttcagccaagcaaaagcagagaaaaaacgtatcgtgcttgcagaaggggaagaggacaaagtattacacgcgacacaagaagtggtttctatgggcttggcatatccagtcttaattggacgtacggaaattattaaagccaaaatcaaaaaattggggctacatatcgttgcagggcaagattttgatgttattgataatgaacataacagccaacacgatgagttatggaaacgttattacagcataatgaaacgcaaaggaattaccgaagcgatagctaaacgtgttgtaacctcaaatacaacagtcattgcttcattgctcgttgaaatgggttatgctgatggattagtgtgtggcttgtttggcacatatagtcgccatttagaagctattcgtgacattattggtgtaaaagaaagcgtaaaagtacccgctgcattaaacagtttggttttaccgacaggaaacgtttttattactgatacctatgttaatgcagatccaacggcggaagaactcgctgaaattaccttaatggcagcaagagaaattcgtcgttttggtattgagcctgcggtggcactaatttcacactctaattttggttcatcaaatatgctaggcgcaccaaaaatgcgtaaagtgttagagattgtgagagagcgtgatcctgcgttaatgattgatggtgaaatgcacggtgatttagccttatcggaaaaattacgccgtgattatatgccagatagcccattaaaaggttcagcaaatttacttgtaatgccaaatatggaagcagctcgtatcagctataacctattaagagcaacgacaacagcaattactgtagggcctattttattaggtatgaataagtctgcacatattcttaaccctgtatcctctgttcgccgtatcatcaatatggtggcgttcgcggcagtgaaggcttagtaaaaatgaaatgagcgtgatttttcacgctcatttacttcttattcctcaagtatttttctaaaattgtttttgataattacggctgccttgtttttataatcgctttggattctttatccatggtaacttcaattttatgatctacaaccacattcatattaatcgtaataccttcaggtggtgtttcaagttgcactttgggagtgcaagcggtcaaatttaagcaaaaaattgtaaaaagtgagtatatagctttcattcttagaagggatttgatttattaggtttatcttatttaatcatcttttttctttaacaatgaaataatctctttcaaagcaatgatttcttcatttttctgagccaacatctcgtctttatgggcaatagtgagttttaatttttcgatttcggcggtaaggttttcaggatttccataatagttcgtattattagcgtgttcattcattagaaatagaacgccttttccctcacaattcatcaattccaacacatcaatattaaaaatttgagcaatttgttcgagtttatgtaaattaagttttgtttcgccacgttcaattttagcgtaaccattggtggacatattcatttttgccgccatctcttcttgcgaccactggttcatttcacgcaccattcggattttttcattaacactcacaaattgcccctttcttgatttgtccacccacaaattgagtggattttccacacagtttgttgttagcagaatgtaaagcctacttttagaatagttcgtattttacacatattttcattaaataacacattaaaataaggactttctatgcgtttgtcagttaaaacagcagcaatggcgattttggtttcactcggtgtaacggcttgtggttcgggcggtagtggcggtggctcatctgcaccaacgaataatccagagcaagccaaacaaatcgaagccttgaaaaaacaggtggaagcagagcaacaagcggttaaatctgcgcaggataatgcaaaccaagcttctgaaaaagtaaaagcaagtgaagcagctaaaacaaaggcggaggctgaattggcaaaagcactgcaagctttaaaagatgctgaaaatgcaactgcagaagaaaaagcgaaagctcaatcggctgcagataaagcggctaaagatttagctgaagctcaagacaaaattgcgtcattggaagaagaattagctcctataagagccgaagcagaaagaaaacgcttagaagcggaagaagaagctaaaaaatgggcatttttaacccaaagtggagaatggcgacatatagcaagaggtgatggtttaaaaggatatgccgaacatgcttatattgatggaaaagcatggtatctttacccaatcggggcatctaagagcttagttttacaaaatgggattgattttaataaaaatacaatatccaataatgttcagattttacctgtatatgcaagccgccaatcaatttctggcgaaaaacagacattccaagttgctaatgttcattttattaaccaagaatactctacttatttaaattggtcttattccgataatataaatgatgatgatctgagaagatcagcaggttatgtcgctttgccgacatctcaaaattcagaatatattaaaacccctgtaatcgcaacttatcaaggtaaagcattaggaatagaaaactataatatagatacaaaaaatgtatatgaaggagaattttctttaattgcagattttaaaaatgaaagtgtcaaagggaatatagccaatctaaatggtaaaaattatgtcttggaaaagggaaatataaatatttcagatcaaggaaatcttattttctctggaaaagtagataataacctagattataaaggtgttttttctggacctaatgcagaagaagtcgttggaaccgctgggacagatattagctttggtggcaaacgccaataatcaatcgtaagggcggggatcatccccacctaaaatctaagctattgcagaaatgcctttatgttgtactaaagaaagcagtttcagtgcagcaccacttggtttttttacacctcgttcccattcggaaacaagattgctacttacatttaagtagtgagcaaaaacagcttgagaaaaattttctttctctctgatttctcggatctcgttgggagcgagcgttttgactggcgttaaacaacgtttatcaaaactccgcattgttgttttatcaaccaaaccaacgtcgtgtaaatcactcatcaattcgtggatcgccgcatttgctgggctgttgtattggctcattggatacctctataaatgctttgccatcaagggatttgggtaaacgctgtttgataacacctgaacctaaatcggcatcaatcagaccattttcaatgtcgttaatggcatttcttaacgtgtcgtctgaaatacgttctttacgggcaaatttatcaaaatgtttagatttaaaaattcgcattaaatttataccactatcatctttagcgtgatagtaaaaaaatgaacagaaaaagtcaataaatctatcttatgaaaaaatatctcccccttaccctttttatccccctagtagcaaacgcaacccccgaattagaaatcaaatccgccgagcctacattaccaaaacaagcggttattttttcagaaaaatccgcaaatagtgaggaagtcactttaactaaagagcttattagtaagcctgaactgactcgtcaaatgttaaatcgggcgattgatagccgacaatttcatttattgcctgaattggtgcggatttatcaacaaacgcctaatcccgatttggtgctgatcgattatgccaacggcattattttggcaagtcagggggattataaaacggcaattgatctctatcgtggcattattgcgaagcaccctaattttcagcctgtgcgttttcgtttggcacaaatgttgtttgaagatcggcaaaatgaagccgcacttgcacaatttcgtaagctacaagcggacggattaccgccacagattgcaaatggggtggaacaatatattgctgccattcaaaaacgttcggattggtctttcgactttggcattaattatttgcacgaaagcaatgttaataatgcctcaagctcgccttatgttcgagtggggaatgtgccgtttaagaaaacggaagaatcattaccgcaatcagcaaatgggttgagctaccatctgaatttggctaagaattggaatgttagcggatcccattatctacattttgagaaccaatttagtggaaaatcctattgggataatcatcaatttgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaatgcccgaagccgtccaaaccgaaatccgctcacgttttgcggtggcggtggtggaaagtaagccgaaaaaattacctgcggtgaaagccgatgtggatttggcgaacttgacaaccaaacagcgtgagattgctgatgctcgcatagggctgatccagtatgtgttggatttagagcaatcaatgagccgaattaaagcggtcacttatgtttgcgaacttgcaaaaagtggcagattgcctccgcatcttgcggtgttggttgaaacggctaacgctaaaaaatcggaaaaacgaacagtcagcgttcgtactttaaatggttgggttgtggattactgcaaggcgacaactgttgagcaacggttaaaactttttgccccactcgtaaggcaggaagttaaggcagaagaaatttggtggctttcttggttgttggggatttaccgtcagaagaatgcgttaagcgtacaagaaagttaccgctactttgaagcggagtgggttgaacggtatgccgacaatccgatgatgttagaggcaatgcctaatatcagcaaagtaagacgagcaatggcgaagttgccgatccatatcttagagaaaggtcgcttaagtggctcgaaatataagcagttattgccttatgtgatgcgtgattggtctccatttgtggcaaatgatatttggattggtgatggtcactcgctgaaattaaaagttgcccaccctgtacacggcagaccgtttacccctgagttgacaatgattgttgatggggcaagtcgaaaaattgtgggctggtcgctgtcgttgagtgaaaacgcttttgcagtgctagatgcgttacgacacggtattgcgacacacggtgtgccagcgatttattactccgataacggtggcggtgagaaaaataaaatacttgatgcagaagtcacagggattttaccacgtttctctatccaccacgcaacagggattgcaggtaatccgcaagggcgtgggattattgagcggttaaataagacggtgggtttacgaattgcagagcgatttgaaacttactacggcaaaaatgccgatcctgaagccactcgtaagatgttggctagacagttggcgtatgcgaatgcaaaaaatggcaaggaactgaccgctttacagaagaaagctcgcagagagttgccaagctgggaagagttgaaggcagttattcaagaagtgattgattggtacaacaatgaacacgttcacagtgaaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagacaattcagggtcatcaatggtttctcggtttaaagatattactcaccttgcagttgaacatatcaaagaattctttgtcgatgccgaagattttgatgatattgatttcagtcaacttgtttccgctaagttacttatacaaattaagaaaccgaccaaaaactcaccagatcagattaagaaagttttttcagcaatgttgaaacctgtgtctgatttagataatatctcattcaaaactcgtaatggtacatcggtaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattttcttccgttctaaccaccgcaaactgtggcttcacgctttcatacacttttttcaggtaattatgattgctcaacggctcaaatttgccattctcccgacgatgacgtcgcacttgctcaaccgtatctgccaacgcttttgccaagacattagagcaagggtaaagcgccagcaaactttgcaaaatccgcaacgcacgcccattgctcaaactactttttgcaggtttaaacagccccaaatatgccaccacaggacgaccacaaccagcggtcatttcggtgatcgttttaagtaactctcgcccagcatcatcttcaactaacgcttccagcgttaaatctgagtgacaaatcgggcaacgacacaatttcattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattttaaagggcgttatttttagaacttatacaccatattatcttcatacttgcctgaatagctcgtcgaagtatttacaacaatacgctcgtagtcttggaacgcctgccagttatcccatttatcttcaatcatagcgtccacataacgcacaaactcgcttttggttgaactgaagaacacaaaaggcggtctggttagatgaattaaccgcaagaaatccactaaatcaaaataagttgcctgtttgtaacttgcctgatgagtgcaaagatatggtgggtctaacacaaacaacgctttcgggtcattttgatattttggcagtaacgtgtaaaaactttcgctaaccacttcaatatcgtctaaatatccgtccgcacttgagtaatccgattggcgaatgcaatgccaaaaatcttctttgaacagctcgtctagtgttgcaacttgctgaccactgaaacataaccacgaacataagatatgttcattgatatagccgtcaaagtttttaattacctcaatgatttgggcttttacgtcattcggtactttcttccgtttttcacaagcagcaagcaatggataaataagtcggcgtaagcggttaatatcatcaatatgtgccaatcgctctgcgtaaccatcgaagtcgttataaataaccgttgctttgggttttaaccgcttggttacgtggctaagcaaaccactgcctccaaacacatctacaatcgtccagccttcgccatcatttgggatattctcaagtagtttcccaaaatgctgtaaaaacattcttttttgcccaataaatggtagcggagcctgtttaaagtaggctacacttttgcttgcttgcttgcttgcttgcttgcttgcttgcttgcttgccggtattttgctctttttccattatcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgagtgaccgacattgaaaaagtggtgtggttgagcgatgtggaattaagggatattcaacgtcctgaatttatccgcacaacgaatagaggcttgattgagtggaacaatcataagtatttcagcttgaatttgttggattaccaaggggaggaagttgttatcggggtggatattcacgatccgatgtgggtgcaggtgcgaaccaaagacggacggtttatctgcaatgccgagtttgaagggaataaacgagatgcgtttccgcagtcctttgttgagcagaagcgtgaggagcgagccaaaggcagacttaaacggaaagagcaacaagtggcagaaattatggcagagcgtaatcctgttattacgattgaacaccagcaaagcgagttaataaccacaagttatcaaccaaaacgagaaaaagtgtctgttcgtcctatttttaccagtgtggtagagagggaggagtgggagaagaaacaagcattaattgaagccgtaggctaaggggaaataatgaagaaaagtgaattattaaaacagtttcaacgtgaagaacagttaaacgttgagcgtaaaaaggtgcgtgaggcaagacgtgcggagttaaatgcacctttaaataataaggcgacctgtttagttgagtttaatggagtggcttttgagctttttcttgaagttcgcaaacttgctccattaaaggcaaatacagatcgtccgctacttgagaaagtgtgtcaagcgtttgcgaatccacaccttccgcctcaagtagatccagttgcatatcaacaacatttgaaaaatcacttagggcttgctctgcaatctctggtgatagggttgctaattggcgaaatagagagtgaacaagctcagactgaataccttgtatcccagttagcaaaacgaggagtgaatgtagctctgatttagtgagtttattaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctctacaagcctttatgtctattatggacgatgttgtgggaggtgataagcaatatcaagagttgcagaataaactcaaaacagctaaaggtgcagagcaagctaaattatttaaggaattaaccgatcttgtcgaggggactgccattggtgaaattatctcagaccgtcaggcgttgatggcactacttgggattaagaataatgttcagctaggtcaaaaggtcgatacagaagttgagaatagtcaagatgctatagaaaaatctcacgctgtagtaagagatacaaatgctcacaaggtggaagccttaaaaaacagtaatgaatttgccgaaatgaaaaattttgagcaggtaaataatgttttgggagcattgagtgaacagctggctaaatatgcgaatgagtaccctaatttaactcagtttttagtgggggcaaaagatgcggtttttgtctttggtgctgcgttagctgcatctagcttattaaatatgttaaaaggcaacccgaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcagtaacagactgaaggatttcatctactgaaattttcccgtttgttgcatctgagattaatttgatgtgtttagctttaataccaaacccacgaacccaattgctaacagtcattacgctaacgccacaagctgttgctaatttatctctactgccacactcggaaattgctttatcaataactttattcataaagtttctcctagttaaaacataaagcaatgataaagcaatctttattttatgtaaagttttcttttgttgatatatttaaagataactttaataattgtataattgataatctggagatttaaaatgagtacattaggcgaacgaattgaacaggcaatgaacttgaagggattaaagcgaaaagaactcgcagaaatgctaaatatttccacaatggctgttggtgatttaataaacaacaaaaccaaaaaacctcgctatcttgttgaaattgcagaagcacttaacgtcgatgtgaaatggctacaaaccggtgaaggagaaatgcgtagccacgttaatgatgtagatgtcattgacaaagataaagactatagcgacacacacattaacattgatatgtacgacattaagttatcagtaggtaatggaaaacctgtaattgaatgggttcctagaaaatcagatgaaccacttttatttcgtgaagcttggttcaaagtaaaacgcttatctcctaaaaactgcaaggcaatgtatgttcgtggacatagtatggctcctgtattagaagattgggatactgttattgttgatatttctgatacagaaattgcggatggtgaggtttatgcggttgtttacaataagcatttctacattaaacaaattattagaacaggcaaaggcattcagcttgtaagttttaatcctgagtactatcctattgacgtaatggatgatgatctaaacaacttacaaattattggcagaaaagtttggcgtggcggttgagcataggagttatttgtagagccacgttgaatcttgttgggaaatagtagtaaatttattgtaaaaatacaaaggaaataacatgagaaaaatcaaactaccaaattcagatcttgcagacacatttaggaaagaagaaacttctgcattaaaagcagcaaaaaatatgctcttacaagagcaaaaaggagactttgataaagataaattgattgatgaaattattatgggaaggaatccacttttaactgcggataatatagcctctcgtctaggtattcctatagaagtttttcatcaatgggtaaaaaatgcagaccccaaatatcaaatccctacaaactcactatttggagagctcggcagggcaatgtttaactcatcgttagaacgaactgaacattacaaatttgctaaacctgatgtctatataggtagttaccctcgatggacaactgaaacattgagatcatggttacgagctaatttaaaatgaaaaaggcaggatagaaatcctgccttataggttatcgaaggtacgtaagctttaccctacgcccaccgggcaacttgccagatgtagctagattaataaagtattccgctattgtcaataattttttagaagatatgtcagtattacaacattttaatgcaatatcgaaaagccgattagcgccctacagtgctctatgtaaaaatgcgtacccaggtgaattacaattctctctgtctaaacgcactatttgcatatatacagccttgcaacatcgtgcatctattttttcttcacttatccaagaaattgaaattagtgtaagaaatgaaatgacacaaataataaaacaaaatcttacgcagaataatgacttattaagtcatttctgttttcttgccattgataagacaacaaagttatctccatatagtcaaaatgaattaaaaagttgcctaatcaaactactaaataacactcttccacccaattattcggtacagcatctcaataacacaaactacgcttaccaaaggcttatacaacaaaatatatcagctgatgatattattgcaaatatgactttcggtttttgggtaaatctcataaataataacaaaagaaagaaccctaactatttgtattggaacaatatattttaccgaaagatatttaataatcgttttaataccattccgcagctctttaatgatttaagagatgttagagattttagaaataggctttcgcatcaagatgccgtttggagtaaaagtgcaagaaccccatctgaagcattaaaaaatatggagataacatataaacgatatgatttactattaagcaaattatctccatatcgacatcattttagaaaagtatctacttatctttcttggcaagagtcttttaattttgatactgatatttttaatgcagaaatcgacagcatgatgtcgaactcgtttatctaactcttttaaaccgcccaccgtggcggttttcttttatcccctaccccacttctacaagtattatcctctataaaaaccactactattttttactttccaatcgttttgtagtaacaaatttaccaggaagaacgacgattacacgcttgcaaacctacctaaactggctactaaatgaattaatcgaactcaatcctgtgattgaactaaaagaagaatatgatttaagtaatattcgatcctttgttattcaagatcctaataacgataacagtgtaaatcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggatacactacttaggcttacaagatcgggttgcggtttaagttcttatactcaatcatacacatgacatcaagtcatattcgactccaaaacactaaccaaccttcttcttgcttctcaaagctttcatggtgtagccaaagtccatatgagtctttggctttgtgtcttctaacaaggaaacactacttaggcttttaagatcgagttgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaactgcgtaatatgactggcgaatcaaacattactgaaacagtccaacgtgtcgttatggtagtttcactgatttgcttcgccatctggttggcagccgacttttatagtgggctttgggggaattggtcgttaaatcaattcatcattacgacattttttacctgattgtcttagtgattggggcatttgctgtcgttttagcgagcggttttataggtctgatcatcggtggactactcgaattactgaccacaatcacacgttataaaacccgagcatagcctgctttaacttgccttttcatctgttcaacccatttgggaatatcgactaaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtagtaacctttccatctacctaaatcttcgctatacccttgggcataccagtttgcttttcttgactcaattaacgctcttgccaccccctcattacctgcaatatccactttgattcgtggtttaatcttcgtaaaatcaatcatcaacaccgtaaaccctaacgcattgatatgcccaatcgccttttgtgtttgacgcaaatacttcaccgccatctgatttgctctattaattgtgtgtgccatctcacaccaccttttcttttcccaacttcacaacgatcacccgttgccctttatttcttcggtgatagctcggcgtggaccatttccgcaccgtttttgctgtcacccctaacttgattgctaactcttcggctgtaccgtcagccacattctcttcgccacgatacgccgcatagatctgacggtatctcatttgccacctaaccaatcaacatcttggtatactctttaatcaaccgttcatcaatttgacattcattgatatgacttaaacgcaccacaccacgaatcaacttgttcaaacgtctcgcattaccttgactatgtttaaaaaataactcgttatattcccctgtgttcaatgctctttctgtcaataaatgcaaatccttttcaggtaacgcattaccgagagaactcgttcgccaaatgcggttatacacttgagctaaatcgttatgcctgccttttaagttaattaacaaacgctcagtcccaaccaatgcaacacccactttagttgcatcgtggatacggcgaataaactccaacgagcgagtaggtaaattctccgcctcatcaatgataatgacccgttcactaccctttaaccttgccacaatcccatcaaacagctgatcaagcgtacctcggttgtttaaattcagtttttcactgattttctgcaacagcacttttgcggtgtagctcatattggtctcaattaaaattacccctgtattctctttcgcatactgcaacaccgcttgcgttttacccaaacctgatgcgccatacactgcacacatatcaccctcaatgtgagcctcttgaatagttgccataatctgacgagcagtaaaagtcggcacaaactccgcactcaccttatactcaagcaccttatcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccttgctcatccagtaattttttaatttctgccaatgcggttgcagaatcaccaaacttttcaaccgcttgctttaaaagttcttctaaattcatttcgtttttctccatcaatgaatcacacgtgaaaataaaattgccatagctaatgccagtctcttgactgtccataactcgcacttctgcccccattcgccctttatctacaagggctaaatgattgcctcgtaaattccgttgaatgtaatcgtacttctgcccattccattccccagaacttcgctcatagctacaacgatagccaagcgataactcttttttgccgttttcgatcttacgagcgagattttctgaaaacgccttaatgtttccgtagagaacaccatctttaaaataaacatcttcccctactactccacttacccctttgcgttcagctggcgtaagtcccgactcttcactcccaagcatagtgtgttcatccacccaaggaacgagcttaaaactgtctattgcttcaggattactaagttcatcggctggacgatatacgggaatcaaatcatctgtatttgaggctcttgagccatcaggcaaaataatttgattgccccgataaagaaaaaccccctctttgctgagggggttgtctttcacttcgaaccaaccatttgtatcaacttcttttttatcttgtgctattgccatttacacaccctttgatataaagcatcaatccatttatcatccatgacgaaaacatttgcacaaagcctgtcaatcctttgagcttgtgatttagtaactttaatcatcttctacctcgaaatcgaaaactgcggacatagagcaaccacaattcggtaaatgccctggaagcccatataccttctgaccgtacatatcgccaatgtatggtggatcgtcaaacgagaatactttcccatttagctcttgatgtagctttctcggctctcgaccaccaccagaatgaacccatttaaatttcttgatgccaagacttttcatattctcagcttgaatatttaagtaagttttacgagtctgatcgattgccaccaagtgagcttttcttgcattacctttatacaatttttgcaaaaaaggctttaactcggcataacctttcccatcacttgaaatagagtgcattaagactttttgcacatcgcctaaatgtttttgcggaatcgttttaattaaacttaccgcttccattgtggctgcttgtgcaatatctttcactcgctcactcgtataatcttttttaatcgccaacccttgccctaattctctcaaactgagatttaaggtgcttttcgtattctttaaggtttgctcaaccatcttttccgttgatttcttcgcaatcaaattgaatattgggttgtacttattaagtaacgcattaaaaaagattctgagctgagaaattaaagagccacctttcggtagcccatcttgtccagcggaatcacttgcataggcgtgtccgtatttttcgtagatttcttcaaccccttttaatgcttctttgtgcattacagcaagagcttttacgacactttgagcatacttctctgaaatacctgcacttacaataaggggcttaccttcaattagcttctttgctttcgctgtctttgctttcattgaaatctacccctaactcttttaatgcttgcatttcatcatcagaaagccccaaaggattgttttcagaatcaacattaccaatatcgtgaaaaccagaatcagggtttttaactaacaccgttctcacttctgagccatcaacaacaccagacatcactaaagcactatacgtatctgccttagttttgttaatttccgccaattccttagccgttggactgtctgttggtcgccagttcactgtcaaatcaagcacttcaagcccactggatttcatcactaattgatggtgtcgctcgacaaattccgttaaatcgtgttcttgaattgactcaagctcttgattgtagttcttatcctcgttttcgcctgtactaaaccctttcggcgctgttcctaagagttttgtaactggcacattagaagcacctgaaaccgcctgatagttagtcataataacatcatcaagccctgatagcgttgtatcaaattgttgaaactgatcgccttctttatcacccagcttaataccgttattatcccgatatttaatccaagccattaggcgttctgtcgcttccgtttcatttgccataaaccgagcaagattcgtaagccaaacagatgtacgttttgaagtaaccaagtttaatgattcgtccgtagtgcgttctgcactatacacacggctcataataagctgtggaacgggatagccaccatacatataaacaggcttgagcaaatcgggaagttttccatttcggaaaatatgcaaatgcgagcggtgatacttcttgccgttaataacccaataagtcggttcatagaaattccgtgcagcaggattatttaactcgccactcacaaagtaaggcatacaccagttaggatcgatttgtgaaatccctttatagctacctttagtcacaccatctaaattaaacggcttttcataaaactcaggatcgtcactatcaatttcaaaaagtgcaatcctcacaccaaaaacacgcccaagccctacaaattcctcacaatttttcttaatttggaattttttgtcatatctttgcaagatcttgactgtttcgtcaggaatatcgtccccgttcatcgaaacaatatcgtaaccgtttctggtagcgtctcttgctggtacaaaacacgctttatttattaaccattgctgacttaataccgcacacaatggaaaaccgataaaggattgactagcaaaccaatcaacaacagagctactcacaacttcagaagctcttaacgccatttttagccgagattcttcatcgccatcttgagcatcaccaccagctaaaatgttattgttggcttgctcaattttttgtagttgtcgttgatattcactaccctttttgtcttttgggaaatttgggtagctgtcttctgcttcttttatttcaaaaggttcttccgttttttttgtaaaaaatccaaacatatcactcacccaaaccaagattgtcgacctttcattaaaggctctaaagcgtatcgcagagcatctatataatgattattttcatctaaaaccacaggcaaaatatcaccacttagcctatctgttttatagctatacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaaaccgtgaagaaattggctactgcatatattgaaccaaacagccgtattcataccgatgaaaacagtgcttatgatgaattaattgtggattacgacttacagcgtgtgaaccatcaaaaagaatatcgtagcgatgaagggattaccaataaccttgcagaaagttactttagtcgctttaaacgtatgtactacggacaagttcataaaatgagtaatatttatctcgataattatgcgaacgaaatagcctatcgggaagatactcgcaaactggataatttaacgattttcaatgatatcactagcaaatgcctttctacaccatcagaaaacgcttggaaagggtactggcaaggtaatcacagacaagtagaaaggttaataatgtaatatggcagacccaatttactatacgcaaattaaacagaaaatcgctcagtttgaacgagaaaaagagcaagtattagcccatctcgaccttgttgaacgccgtattaagtggttagaacgagctttagaagcaatggaagttgatagcaaagagattcaacaattcgataccgagcattttcaatatcgagtttatcgcaaacaatttaacggtaaaataacgcaattgattcaaaaagtaatgaaagccgaacctgaacgatattggcgtgcgttagaattagcagaagcggttttaattgcagataaacaaccgaatacccctatatcaaaataccacaccaataatataggtaatgcaatgactcgattagtaaataaaggtgtcgtagaaagaatcgtagtgaaagaacataagattattcaatggaaatggatacaaaaatagcggcaaaatgtcgctattttaacgatttcaaccgccaatgaaaccctgcacgctcaacgagcctctcccacaatttgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgttttgagcttcttgaattgcttcttgaatgtctacatttgacagcaagcgactaccttcacgatttgctgttttttcagcataaccagacctaatcgccgcttgtgttgcgttaagatcaattaagtattcttcaacaaaccgctgttgtttgtctgttagtttgaatttacccacgcctttagacgtggatttaacctcgtctttcttcgtcatcgtggttaatcctttttatttcaaaacattcaataaattagcaatggcattaattagctttggtgaaacaaacgctaaaataggtagtgttactgcaaggcttatttgccataaaccatattccataagtatctccttgatggttacggttaaaactgtcataatctccataaatcgttactcattcggctttaatgggtaatgaaaaaccccgatcatttgcagtgatcggggttttgttatatataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccactttttacagtgagctataagttctgttaagataaagtttccacacaataaaataacagaggtttacaatgattaaagcaagaatatcccgtcaacaaatcttaaataacattcctgagcagtatcgccattattttaatattgccatttcagatattgatcaagatttatatccactttttaaaaattttacagatgcggcaaacattctgtgtaaatttgctcatatcaacaaaaaaatagatattgttttctacacggaacttgagcctacactaaaaactaaaaccgcatctttaaatatagcgttaatcaataaagataccattcatttctatgtcggacaaaccatcttctacaatcttgataaagccattcaatatccaaacgaagttcaaatcactgcatatttagaagaacttgttcatgtatttatgaatgtcaatgatgaagttcttgtaaaagaaatagtatcttcaatgtatgaaggtgtgacttacaacaaagaaaaagatatatacaaatttaagtgaaacttgaagtttttattccacttgaggcaatatgctgaccgtggataatatctgaaacttcaatttcatctgatttaaatttcatcttcaaatcttcataaagtgccttgagcaaatactctggcacttcttcgccattgattttgattttatcgcctaatgtaatttccatcccttcccccaaacaaaaaaccccaagcatttctgctcagggctgtaaaattatttcgctttctctcgcttgtacgagttgcaagcatagctgaaatgtactacttttcactcaagctgtcaatcactttttgaacaattaaaattcacacgacttcacagataatcgttgttgattaatctgtggcaattttctttttgccgtttatcatcttcataaaacggcgtttttcttgccactctcttgaaagcaaatctctcaagcggtagttttctgcttttagttcctcaatttctgcttgtaattgctcaattagctcaacttgttgcttttgttttctgaagttaaacatttgataaccttaaatgaaaatctgaaaacttacaaataattcttgataaattattatttgtaaattataatatatttgttttcgcaatagggcggaaataagaagagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatggaggggttatgtgtgagtttgaaaatgttgaagagtatttgcctgatagcgttagagagattgtggcggtgattggattgcctgcaacggagaaatttgttaaagcctttgggggcttttcgtttcagttctcaaagtctgctaagtattttgataaattgcgtgaggtgttggggcaagaagatgcagtaaaactgcaaagttatatgcaagtgggtgaagtttatattcctcgctgtgaaacggcattgcggattttgcgaaatcaacagctttatgcggatttttgccatttgaccgaaacggaaaagttaagtgggcgaatggcgataatgcgactttgtcagaaatatcaaatttgtgatcgcactgcgtgggaggttgtacgatattatcaacgttataaatctgtatctcagtcagtcttgttttagtgtggaaagtcttcccatactctctttactctcaattctttaaagtctctttaagtatcacttaaagaggctttttttatgacctttcctattagaaaaatcgtaatccattgttccgctactcgtaatggtaaaagtttaaagcaatcgggcaaatcatctgctgaagtgattgacagttggcataagcaacgaggctttaagcgactggcgggggcggtgaaaacctttaattctcaccttgaacaccttggttatcactttgtgattgatgtggacggaactgttgaaacgggtcgtcaggttggtgaaatgggggcgcacgtcaaggggcacaatctccactctatcgggatttgtgtggtgggcggtattacggctaatggtaaaaatcacgctgaatttactgaagcacaatggctcgccttgcaccgtttactgcgtgagcttgaagcgaaatacccgaatgcgaagatttatgggcatcgggatttaagtcctgatcgtaatggtgatggcactattgccccgaatgagtgggtgaaagattgcccctgctttgatgtgtgggcgtggttggatagtgaagaagttgtgaatgtggggcatttatttagataaatctccccctagccccctctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcgcggtctatttcactcacgttaccccaagtgaatgtgactaatttatattttggtaattctaaatttgcttttaaaacacgttcacgcaattcttttaacattcgaagcccccttctttcattttttgttcaatccaacggcgagcattgatgatctcagcaatcggctcttccgctttttctgtccacatttcaattaaaaatgccccacgatagttcaattctgcaaggtttttgaagcaacttacaaaatccacacaaccatcgccaaacggcacatcacggaattgacctttgcaggtttcagtgactttgtaggtatcttttaagtgaatagccgagattttgtcgatacctaatttaagctcttcagcaacattgtcgttccacgcagaaagattgcctaaatctgggtaaacggtaaaccacggtgatttgatgatctcgtcccattttttccaacgagaaatcgaactcataaattgggtatccataatttcaacggcaatcgtcacttgattgcttgccgctaactcaaccgcccactctaaaccttcttggaaacgttggattgtgccttcgtcttgttcttcgtaatagacatcatagccagcaagttgaatggtgcgaataccgagatctaccgctaattgaattgccttttccataatttcataggctttttggcgagtagcttcatcacggctaccaaacgggaaacggcgatgtccggataggcacattgatggaatggttacacctgtgtttacaatcgctttgacaagttttaaacgctcttttttactccaatcaaggcgagcaaggcgttcatcagtttcatcaatggaaatttccacaaagtcaaaaccacaggttttggcgatagacagtctgtcttgccaactgatatttttgggtaaggctttttcataaatacctagtttatgttttctcattcttaacccctttggttaaatgtaaaatatgtgaaggttgtagccgcttgccttctgatttgttagggcggacacatcggtccgcccctacaataacatcaggatttctaagccaaaatcacttccaaccctttttctctaagttgtttaatgatttcaggatcagcttcagaacctgtaatcaaaatatcaattttgctcagttcactaaataacattcctactcgtttacctagctttatactatctagtagcacaacatatttctgagcttttgacgacatctgattttcagagtgggcgataatcatatcggttttatataaaccttctagcgtaaaacctttcccactcgtaaacataatatttgccgcatagctcatctcatttccactgatagacaatgtaatcgctttatttttattatattgtccgccaagaataaccacatcatcgtggttatgatcaatcaaatgatttgcaagcggtaaatagttagtaataatttgcaaacgctgaccacataacctgctacctagcatcgacattgtagaaccgcaagttaatacaacactatccccttctttgcacaatttgctagcagcttcggcaatgcgttgcttttcatcattatttttaatttctctattcgatggaataaagcccacactgatggcttctgcaccattacggactttatgcaaacgcccttgctcacttaacttattaatatctcggcgtgctgttgcaggggaaatacctagtaattcaataatctcttgagttgaaagtgcttttctttccgttaaaagatcgagtaattgccgatgtctataattttcgttcattattcatctccttattttatgattattttaaaccaaataatgaacaatttcccccattttactggggggattgattaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtataataaagttttctttattttatgtaaagtaaaatttaaaaaatattttaatgaaaataaagatatctttataagcgattgatttataaagagaagcgattttgtaatgtgtgtttaattgcttgttttttaatcatcttcttgatatcaggaagatgtttttgcaaaaaattggggaaatgtgaccgctggttgtgtgtgtttttggtgggttaatagtagtatgaagtagttaatagtagattttaggcaaaagaaaaccgccacaaatggcggtttaggtctgttcttctttcattactttctctgcgatgtcaaaaattaatttttgaatggtgaggaagttgataatgaagtaaattaagctaatcaaagaaaacaacaatgcgacagtttctggattgaatattattgtaagttcaatcgcagaaagcgtatggctatgaacaatctgacttattaagaaggtgattgttgctagtgagaaatacatcaaaaagctatttcttacatttgcgatgttttctttgacccgtttaaatatctgtggatttttaatggcacttggattaaaggtacaaacgatccccattccaatagaaaacataatgccagataatgtgtaaatggtgggcacaacagccttatacacaccttcttcgggtgtgtataaggaagatagaaccaatgcacctactaatgtagtaaggctaacgacaatccatttaatttttacctgcattttcaagttcttttataaaaagctccatttgttggaaaagtgtctgttcgtttagttttcccgtatctgtggtatctacttcgacctgttttgttctttgaagttcactgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaacgataacgcagatgtcctaaggggggctcatggagaacagaaatctccagtagaacaaaagggtaaaagcccccttgattttgattttcagtgtgaatacaaaccatgaaagcgtggcctatcgatcctttagaccttcggagtttgaagctagaggtgtcagaaaagttaccacagggataactggcttgtggcagccaagcgttcatagcgacgttgctttttgatccttcgatgtcggctcttcctatcattgtgaagcagaattcaccaagtgttggattgttcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccgctaaagcaattgtagcagctccagcacctattaatttagctccttctaacatgtagagtcgcgacatgacattgtttcgcgcttttccttcgctactcgaaatttctagtatagtatttctcgttgatttgattccttcctcctctccttagttgaaaagcgaaaggagttgcttcaatgaaactggaaaacctaaaacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaaaacaagctaaaaaacagattagtgattggcagttggaagcctttgatttaactgtaactgtccccgaccataaaactgcaagcggtcagttatggcaagctgggcaacgggttcacgttatttgtgaagagtatgagatagatgcgattttctttttaatgggacggtgttttatgctttctagggtaggcggtacacaaacagagcttcgttttaaacaagacggcatttggacccctgatgcttataaagcaaaagctgaacaagctcgtaaacgtaaggggaaaaagggtaaaggacgaaaagaggaaaaagagctggtcggctcgtgggagttaggacaatgagaaagttagcacaacaggcaaaacaacgtattaacaatgctcaaaattcggtacgttctgcttttaggggggtgttaaatttagtgaaaagtactccgcaaattcaactttcacaggtgtctggcttggcagatgaaacattgcaagatgttgagctgatgcaacattttggattgacatctgttccaccagcaggcactcaagcggttgttattccgcttgggggtaaaaccacgcacggcattattattgcgacggaaaatggctcttttcgggtaaaaggcttaaaaaatggcgaaacggcaatttatgatgccagtggctcaacgattattttaaaaaacggtagattaattgaagtggattgtgatgtttttaaggttaaatgtaaaagctacgaggtggacgcaacaagtggggcgagttttaaaacacctaaattagaaacaaatcaggtctttaccgctcaaggacaaattaatggcaatggtggtatgacggtgcaaggcggtaatggagcgagctttagcggtgatgttacgcagacagatggtagttttagtactgatggtgatgtaactgcaggtagcatatcccttaaaacccacactcatcaaaacgacggcagagggcaacctgtggcgtaatttatataagcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctctagggcaaagtagcacacccagagcagaagtcctacttcagccagatcaggcctgcaaagaaactgcgtttcacaggcctttggaagagatgttcccggtaggctgtaagagcactgtgcagagcgagttgtttcttagcttcccaaagagctggaagcaagatgctgtggggcccaactcgccctttggaaagaagcctgcacgttgtgcctttcagctctagggcaaagtagcacacccagagcagaagtcctacttcagccagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaatatgcaacttcgtggggtgtttctaatggggtgcattttaatgacagatggaatttttggggggtgaaatgatggaaattaaatctttttcttttggaaaattaattgcggatttagctattgttggtggctttgtttattcgcacttgtatctcacggatagtgcagtagtaaatgtttatatttgggctttctgggcattttctattttaactttaatgtctgcgtttattaagcccactaagtttttgttcacggaaaacagagccaagcaaatgattataagtgagttaactattagcttggtcttggtttattttgggtatccagtattagctacggtcggttttatatcaactcttgcttatgctggctgtagaactgtaaagaacaacaagaaaacaggtaaacacaatgagtagttacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgtttgaatttgactatctctaaataggccgtatgtcagggcgaataaagattcgcccctcatatgattattcaatcacaatacgatctcggtttttttcaagtgtcgctttcccgatacctgaaacttcggtgagctgctcaacatttaaaaacttaccgtttttctcacgatattccacaattgcctgagcctttttcgctccaatacctactaacttatcttggatttctgaggctgtcgcagtattgatatttacaacattcgcatttactttttgtgtcgctgcgacttgttgcatcactactggtgtaggttctgttgacgtagttactttttcttcagcaaatgttgttgcagagaaaaacccaaataaaagactgaatgtgtaacgagaaagttttttcataaattactccttaaaggttggtttaaattgcacgcataccttacaaatcaaacaaacagcctgcaatgagtaaaaatgtgtttttcgacgcagatcgaaaaaattgaaaaatcttctagacaatactgctatttttttgttttagtaaaaagttagcaaaaatagcaagcttattgtgaaatttttctgaaaatccatcagaaatcctttagaataatacaatgtttccttaaacttaatcatttgggatactcaaaatgagccaacaaaatttacgtaaagaacctgtttttggtgagcctagcgcagtaaaaacagagaacgaaaattcggaaagcaaattaactctctcagcacataaacttactaagaaggttaatttttcattacattcaactaaatcgccaggacacacttttactccagtaatgaagcgtcctgtaggtggtactttttcttttgcctcaatggaagaacaaagaaatcaacaagcttcaaaagagcgtacattggagcaacaaaaaacatctgcatttatgttttctcctgttgtcaccacaacagaggagccattatctgaagcaccccaaaaggaaacagaaacaacaaatgccgagcaaccagcaatgactactcaaactatagagagaattctgcctagttctcaacctaattttcaaaaatcaatcgcagaaaaggtaccatttcaatctcgccgattacttcttgtggggacattggtattggcatcacttttgattcttttcttgttaaaaccaaatacaccagaaacactggaacaattggaacaagataatgctctacctattgaattccgcccagttgatgaagcagaagcgaagcgcgcagaagaagcaaaagcattaactgccccacaagctcaagtagagcaagcttccccgatatctccccccgtaaacaccgtagaaataatactgccattaacaacgggaggttcggcagtttcatctaacgttgaaaatgcttctattacgcctatttctgtaacaagtacagaaattacaaagcctactgaggaagtcgtaacaaaaccaacaagtagcgcaagtgtgagctatcagatggaagaagaaaaatcagaagtagagaaaattcaagctgagaaaactcaagtagaaaaaattaaaccagtttctgctgtaactcaaaaagcagaagtcaacatagaaaaagagcagcctgctaaaacaaaagtggtagtcgtaactgctaaacctgttgttacatcagcttcatctggctttatttcaagcaagacattaacgattccaaaaggtgtgtctttaatgcaggttttccgtgacaatcacctaaatatttcagatgtaaacgctatgagcaaagcaaacaaagcggtcagcaatctcaaagtcggagaaaaagtaactgttcgattagacaaaaatagccgtgttgttgaaatgagaataaatgctggaatttatactcgtcaatcaaatggtacttatatttttaaataataaatattgaggcaataatatcatcattgcctctctctatatttaaaaggagatatgagatgatatccataatagtgaggaagtattcttcaatatatgcaatgatagcattgctctctgcttgtatggtacctgctgtatcacctgtttctcaacttgaaaagtcattaataccaacaaaaaatacccaaatgattgttaaaattaatgaacgtatttattacgaatatctatgtgataataaacaaatcgttagggtacaatatgacaacacaaagaaaaatagagctgttgatattacttttcagcaaagtacccatacgctttattcaagtgtgacgaaaaaaggcaaaaaatacagcgatatccgctggatatggtcagaagattttgatggcaaaggcacattgcgagataaccgcaataaaatccttgccgaaaactgtgtgaagcaataggaagcataatgaatattttagttattgcaccttcttgggttggggatatgatgatgtcccacgccctttatcaacagctcaaaaccaactatccaaattgccaaattgatgtgatggcacccgactggtgtcgcccgttactttctcgtatgccagaagttcgcaaagcgatttcaatgccaatcggtcacggctcgtttgcgttatgtaagcggtacaatttaggcaaaaatttgcgaaatcaatacgatatggcaatcgttctgcctaattcattgaaatctgcttttattccgctgtttgctaaaattccccaacgtcgtggctggaaaggggaaatgcgttatggctttctcaacgatttacgcacgaataaaaacgactatccgatgatggtacaacgttatgtggcacttgcgtttgagcaaggtaaaatcccgacagcagaaaacttaccgattgcttatccttacctacaagtcgatagcgagaaaattgcacaaaccaaacaacattttgctaaacagtttgaatatgccgaaaaccgcgaagcgattggcttctgcccgggttcagagtttgggcctgcgaaacgttatcctcattaccactacgcaacactggctcaaaaactgattgagcaaggctattccgtgcgtttatttggttcaaaaaaagatgaagaagccggggaacaaattcgcaatagtttgcctgaagccttacaacgctactgtatcaaccttgcaggacaaacggatttaaaccaagctgttgatttaattgctgattgcaaagccattgtcagcaacgactctggactaatgcacattgccgctgctcttaaccgaccgcttgttgcgctctatggtccaactagcccgcaatatacgccaccgctctctaaatctgcggcgattatccgcttgattgaaggtggtttaatcaagatccgcaaaggagaagggcaagacggttatcaccaaagtttgatcgatattcagcctgaaatggtgttggacaagttaaatagtaagctgtcaaaaaaaagttcactttaattcttttcatagacgttttttattttatttctctagctatttagataaaataatcgtcgtttattaggtataatcgtttgaccttcggagttgcaatgaaaaatattttagtgataaagtcaagtattcttgcggataaatcaaaatctaatcaattggttgatcacttcaagtctcaaatttcagctaatattatagaacacaacttaggtgaaaatccgctcccgtattatgatataaatgctgtattagatatacgaggaaaatcacaagatgatactcaatataatgctctgactctttctaataatctgatcaatgaagtaaatcaatgcgatctcattgtatttgctgttcctatgtataatttaggtataccagcacagcttaagacatatctagactatttaacccgtatgggcgtaactttccgttatacagaaaatggtcatgaaggtttaattaaaggtaaaaaagctattgttgtgcttactcacggaggagtctatagggatacgcctacagatttagccaaaatgtatatgcatgcagttcttaattttattggtatttttgacatcgagtttgtttacgcggaaggtcttggctatggagcagaaatttcagataaagctcttgaagcggctaaagttgaactggatcgtattgctcaaacattctaatttaatgataaatacaccgtctaattaggcggtgtttttatatgtaaccgtttgtcttttatccatatcaaataactacgcaatatttacaaataatcatttcaatcttactgcttttcagttagtttattactgtctatttgtttatcttaactataaggaaactcactatggaaactctctttcaagtagctcaaaattggttagatcaagatcctgatttagaaactcgtgcagagttagagcaattgatttcgcaagcaaaagcaaatgatgcgaaagctcaagctgaattatctagccgttttgatggacgtttacaatttggtactgcaggcttacgcggtcgcttacaagcaggttcaatgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacttcacttgttgccttttctaatcgttcaaaagcgtgtttaaactcaaacccactcatttcagctttagcaaattgatgagccaacttttcaggataaagatcaaggttaggcttataagcacgtcgccctacgttataatcaaaaccactatctgtcgtcagcaccgtttcatcagccatttttaagcctatggtcttttgctttacacctttcttcggctcaatttcgacttcgtctaatagcttagaaccatctgaaaccactagctcttttcgctctaaatcacgctcttttagtgcattgacagtacaacgacaattaaagccatttggtgggtaaaatgtcgtccaaaatggatcgtcataacgaaaaattaatccgtgcatagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagccgatgcagaagctataaatatgggattaacaacttggaaaaatgcaccggatggaaaaattttaaagagtgatgtcagtattgctaaaaattatttaagcgagcaacatattaaagagttagaacagttggtttcagcttatttagatttagcagagaatagagctactcgccaaattttaacatcaatggcagaatgggaaacttttttagatagcttcttaactttatcaaattatccgattttacgagataaaggaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggttttgcggcaaacatcattacccccacagcaatcataattgcaatcaccataacaggaatatcatctgccataccaactgcggtgataacggagtctagcgagaacacaatatctaaaaccgcgatttggataaggatcataaagtaattcgctttcttacttgtgttgccttcagtatcgtgtgcttcgcccttaaccgcttcaatcagttccattgcacttttaaccacaaggaacaagcccccgaagaataaaatcaggtcacgtcctgaaatcggtttatccataatcgtaaagagcggatcgactaatcgcatcatccacgctaatgaaagcaagagaagaatacgagttgccatcgctaaacctaagccgataatacgcgctgactgacgttgtttttcaggtaaatgagaaactaaaatactgattaaaataatgttatcaatacctagcacgatttctaacgctgctaaggtaaagagagcaacccacgcttctgggctggcaatccactcaaacatagaaagatccttgataaaattagacataacatcggcaaaaattgccgaactaaaagttgcacatcatatagagagctgtggcaaaattaaaggggcgaatgcaaaaaattttgtaaaatctctgcggtaaatggtttacgcaaataaaaccctagtggcagtgattgaattttttcaccatattgatttacagcccctgctaacgccttattatttcgcccttttggacgcaaatgaagcacttcccctaaactcgcattgatctcatttaaacgtccaagcacaatcagttccattaactcttcccagtcttgttgtaactgctgttcttgttgttgggacggcgaccataaaatcggctgtccgatatgccttttttcaaggggaattgaccgcttaccttcgactgggatccacaaaaccctttgcaatttatgtttaacatgtgacgtttgccatacaataccgtgattatccgttaaaggcgcaaggctgacaaaggtagtttctaacggcaatcctttttcattgacaggaatggttttcaactcaatgcctaaatgggcaaaatcttgttcaggcttactgccagcctttgcccctaacgccgtttcaataagcatacccacccaacctttatctcgacgtaaatcaggcggtacaaccatattcaacagttcggcaatttcccctagggtaaagcctgcgagccattgagctttggcgagaagctctgtttctgtggtggaatgggtggcaagttgcattgaagtgcgatctcttatgcgaaaataagcggtcacttgatcataaaaatttgcaaattttttatctgaaccgaccgctagttattcaaatataatgcttttcattttaccatattttactaacaatattttcattgagaactcttagtatttaagttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacaaaggctcgaatgccaaagacttattccttattgcagaaatatgcagagcaagacaaaaaacgtgttgttataggaaatggtgtttcaattagattgagctaattcaaaaacaaggaggaagctatgtaaccactaataaaccattcacaccgccccactcaatctttatcggcagagcctaaataaaattgtaaatgcacttggggcggtggctgagagaatagagataagcgtcagcgtttatctctgttttcttagggaggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttgccctttgcctttgtaatgttccattgattttgcaaaattaatccctttttccttgcctgtttttggatctttatatttcaaatttttaaagcgatcattggtttccttagcggtaattttgcccaacaaattgactaaattattgccagcctcatcactagagcctgcagtcactcgtgcttgttggttagcaatcagcaaacgcttaaacccctctaaaccatttaaaccagcctgtttaccagcagccatttgttgtggcaaccacgcagccatatcagcaagctcgaattgtcctgcctgccctgctgcaactgccatatctaaaactttgccaatatcttgctcaccaattcccatttgttgcatagatgaaatagcaatctttgcaatatcgtcaggcgttgctcctgttgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtacggtaactgagcttttgcaggggcgtagtttaaaagatttggatgtgttttctccaccatcatttaataatgatgatgtggcagattatgcgaatttggaaactcattttattgattcaagtggtcagatttcatgggatctttttaaatcagaaccagattatgaatttgctcactgggatttttcaggcacaacagagcaggaatttgctaatttgatggaaattttcagccggtataaacaagaggtttatattatggactatgaacatttaggtgtatacgcttgccgtataattgctcctggaatgtctaatatttatcctcctgacgatttgatctatgcgaataataatatgggaatggaatggcgtgaaatgttgcttgatttaccctatttccatcatgagaaagaaatttatcaagagctattggatgagctggatgagcaaggtattgatgatatgacacgggtacgtgaatttattggagtggtagctgaaaaaggaagcgcactacaaactttacgtattggtgaattaaaatctatgcttcatttggctttagggaatcttgaagaggcattagattgggcaacttggacagttaatatgaatgcttctgtattttcagcagaaagaaacaattactatcgttgtttaattagtgtaattgaattatttttggatgaggatagggaacctgagcagtatagaatgatatttaacagaatgtatgggaaagatgctgtagattttgtttggaatatagtgcagggagaaaatccgttccatggtttaattggttctgatgaaactttgaggaatatgtcagctcatcaaaaattactagatgcataccataagctacaaaaagtaaaataatagaaattacattgataaatgtagtgtgataaaaacgcctatgaatagattctatttataggcgtttgactttctatttcattctagcatctaaggatgatgttgggataaatttagtatcctatctttcatacaatgagctatttctgttaaatatttttcttaaaaagaggaaaatatgtttattgaggacttaaattgcaaaaccaaaggcatagaatgcaactaatgcaatagcaatagctactgtaccaacgttcaatttgttaaattcacctgaaatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactaccacaaaaaagccccgaataaatcagggctatgcaaaaaattttgtaaatatcaggttcttcgcccattccgatgggcattcactgctaacatctgcacaattttaaaaatctgctctgtcgtacaccattgcaaacgctcaataccaaacgaccgcttacaaatagcgtgaacataatgccaagacttaccactactagcgataaaggcttcaatctttctaatataactttgacgcacctcatctgcattactggctgtcgggcgtttaccatattttttcgacttcactttaaaccctttggcacgcataccttgcaacactatcatcaactcagggtcagtcatcatcgaacagctaggtttatccaccaactccattaaaaagagtttataggtttcatcgctcatcttcagctcagttttgccaatatggattttctgtatcatctgcttacgagtttgtgcgtacattctctttctcctgttgccactgtttccaatccgcaaagccgtgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattaacgtcccattagactcaaaccaacaatgcaacccagcagaattggcacaacgcataattgcttcccacgctgtttcgctaatatcaatatcaattttatccagagtaggattattttctgctcgtaactcaacctgtttaatccccaatggctctacaattttcttaatcgcatcaaatactgttaagcctttcacattcataataggagcagaacaatccaataaaattgaagccctatctcgcccattaatggcataataacgcccactcttactgatctgatgttgcgtattatcaacaatacctgttaaaactgtctcaccattaattttgactacggcagttttacctgcaaaattcggcaatacctgcatttcactggatttgcctaaatcaaatgaaaagctatctgcaggaattaaaaaatcactatcaatattgtagcttttccagtttttatgttgcttgccatctatctcaaccacaatctcattttcaatcatcatcttactccgaataacaatttaatagggttcctgcttcgatccaatttggctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgagctcgtactctaagccaccacctttacttttacgtttttgtgctatccagttttcccttttagctttttctaaaacgtttttatgagcacttggcagactagacaacttaaaacttaatagctctgcgactgaatagtgcgtttttaaacttaattcactcataaacgttcctttaatctatcttttacgttaaagatcatttatgattaaaacttattagttaaaatcggtcgtttattacgttctatgcgttctgcattgcgaccagcccatatcacttcaggggcaacaccaatcgcatttgcgattaggcgttccattttgggataaggcttatctagtgcagatttaagggtgttataactcacgttcccttctgttgctaaagaacgaagtgtccaaccgtttttgcgaagtcccgccagaatatcggctcgatgccaatcactctgagcggtttttttaacgtcgctaaatacactcatttgatacactcctttttatctatctgatgtgtgtatttaaccgtaaaactttagataaatcaaccgtaaaacataatatttttaaaaatatttttgctttattcatattttatttataaatcaatggtttagctatatgttttacgagtaaaacttaaatatcggaaacgtaaaagatgagtaaaccaaacatttacgatgaaaagttttcagaaagaatgaaaatgattgctgaaaaatgttttaagagtaattacagtgaattttctagagctgttggagttgctcaggcatcattagctcgttgggtaaaaggtgaagcggatccttctcgctcaaatttagtgaaaatagctgaagtatcgaatgtaaatcttttgtggcttgccacagggcaagggcagagagatgacacaagtgaagaaacacctgcaagtaacaccatacaggaaaagctaaaagataacatttcaatgattatcagctatgaaggcattaatgtatcagcaggctttggcagttttaacgaaggcacaaccgagcctgatggggaagaaccttattcagatgaactcttggcacgtttaggcgtaaaagcccaccattgcgcagtattttgggcaaatggcaactctatgagcccaaccatagaaaacggcgaccaaatgcttgtagatttaagtaaaaaagaagtaaaaggtaaccgtatttatttagtccagaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgtactgtcagtagtatttgtactcgttgctgttatactttttggtgtgataaatttaaccaaatcaattgtagcaatgacagcccaactgccttgatagtttgaggtattaaaattaactttattttgattcactaaactaaccataaatttagtaaaatcattagtaattaatactgcacctttctcatatccaccaattttctctgcaaaagaagcatcgaacagatattttccacctttgttttggtaaacgatatgctccgtaatatctcttaatataccgttcatatctttaccagatggtgcttttcccccttgtgtgattggggtcattgtgatctggggaaatccttcctcgtatgtggcggcactttgtgccaaaccgctagttctagtttcaggaatatccgttttaagtcctaaactagcccaaatttttgataataattttggttgtgccatatttactccaataaaaaagcctgtgaaataaattcacaggcttgtattactcattaattaatctatctatcacctatataaaaagcaccttgcccaaaaggcgccatacctgcttcattaaaaccaaatgcattccttatatctggttcatagaaatcaactaaaacacctgtaggtctaggtaataaatccgtacttataatgacagctttttcaataggtgtaagattaaaatcaaacacatatctcgccatcattgtcccattcttaatgaaataagcccttcctctcttttcaaaaagactggacactaatttatttatatggggagctgttgcataaatagtattactcattgctttgaaaaatatcattgctctatacatttcatcattcattagatgtcgagtaccaacagcaaaatcctttaaatcttctgttgctaaagttgagctaacaaactgatttttctcatcaacttgtatatttctatttatgccaacgattttcccccaaatatcaagtcctatacctctagctgtatcaagattccaaattaaattataaaatccctctatatcaactctcggatctagattttcattaatattcttcagcagactagttatgatcggactatttgcatattggctaataattgttttttctagctgtatcatataaacaccacactaatatttgactccgtgagtgttggatattgatctattcccaattcgattgaatccgcatatacagatttgcttttccctatttttatatccagcaggtgatctttaggtaaagcattaacaacatcagaaacaaattcaatggcgtaaagcgttgagccaattttcctacgattttgcttatcgaaagtattttttattgtagatttgactagttccgcacttcctataactgaacctgttcgcaacttcacttgaaaataaataggggtcaaattgggtcgcataaattttatctcatacactggtctaggaactgtataactatcatcttctacattcactgttgtgtcaccagtaaaatcacacccatttccagcatatctccatatagtttttgctatttcctgatcatttccacctaataccgcaacataaacactatgaggctttaacactttatttgttattcctattcttgtttctgtgcttttaggattatcaataacataacaatcaacaacaccatctaatgaagccacattagaataaacagaggcaggcattcctaaagaatttttcgctacactttttttataacgttctgcaaattccgaaccactttctttttctgttcctgtaatagcagggctatgattatcaactctatccaatcctaagattgactgatgaattttatttacactattagcagcagctgaatatataccttttgctgtaagatttccgacaacttgaccagaactcaatatactgatctcttgatctaatacccagtcattattattttcgtctttaacaataaatccctttggaatcgttattcctggaagtccataaaaagtacattcaactgttgagttaatctgccctttccgcttaataaaatagagtttacctatcgcatcttgcataaacccttccgaataatcagggtccaggttatttaccaaccaagcaatttgattatttttatctgcaataatcgctgcgatagagcttgccaactgtccttgtggagtttctaaatttttattaaggtttccgccaaatgcgtcattaaaatccgctaaaacaccgtttaagatttcttgctcggttggcagaattagcccttgaggcgtaaattgtatgtttgggacatttgtcataaattaacctctacttttcttcctttatcatcagtgaacttgatcgcccctgttattgttctatccacattgctttgaataatggcttttgccgaaacaacttcaggtacagataatgctgctttctctaagcgatattgatacaacgcaagagattgtttcttgcctaacgtctcctcaaaataagggataccttttgccttatcatagtaaagctcacctttaaagagcttaatggcactcgcaacatcttgagcctttgcataagggtcttttgtataagctatattcccttcatcatctaacattaaatcccatctttcagggtgtaaaaagagtgtatccattacttatacctttacatctggggctggtccgccgttgtgagtgtgattattgtgagattgacgcatactagacatcgatttaccgccagatttagcgttatcagtaatatctccacctgcggttattgttgtctcaacttttagcgagtttgttgtttcaactggtgcatcaagtttgatttttgagcctttgatataaacttcgcctgtcgcaaccacatcaattcctgaatctttgaagaagatgtattgctcaggcacgccatttaaaaatccaccaaaatataagccgtccgcataatcaaacttacgcaaactttgcggcgttgatggtgctttattggcttttactgaggaaatatctcgactacaaaacccacacataccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgtatagctacaaaaccgaccgcttgtctggcgatgtgttgccaacattagttgatgcccataaccactatattgatgcgttgcggtatgcgcttaatcctcgtattcagcggaaaggggattttagccaaaatccacttaaactttactaaggataatttatgtctgatgtttctattgttatgcgtgaaatcagggcgttgaatgaaaaaggtgtgatgattgatgatttgcttggtggaacaaaaacaatgcgacaagcagggaaaaaatacctttatcaattcagtcttgaggaagaagaggcttataaaaacagacttaaccgctcaacgctttatcctgctttatcggaaacgctctaccaaatgacaggtagagttttttttgagccgattacgacaaataacgttcacgataaattaaagcaagatattttgcctgatgtggatttagagggaaataatgtcgatgtattttcttctcgttggtttaatgcaggtttaacttacggcgtggcatggtgcttggtggattacactcgtactgagaatgttcgtaccattgccgatgagaaagccgttaatgctcgtccttattttattttgattaagcctaaaaatgttttgggatttaaaacggataaaatcaaagggaaacgacaaatcacgcagttccgatatatggaagaagtgtcggtagatgatggcgagtttggttcgaagattgaaaaaataatttatgtgtacgaaatcggccgtatgcgtaagtacaaaaaggcagatggtcaatggacgttgattgatgaggtgcaacttcttgctcaaaatcgaccgcttgaagtggtgcctgttgtaccgtttattacaaaagaaagtggagtgcttgcgttaggcgaaccaccgttgcttgaattggcttatctgaatattaagcactggcaatcacaatccgatcaggacaacattttaaataccgctcgtgtgccgttattagggattttctccgatactgaagtcaataagctacaagttggtggcagtgcgttacatttacccgcaggttctcaggttgcttatatcgaacattcaggcaatgcgattaatgcagggcaagagagtttgaaagagttggaaagtcaaatgcgtgttgcaggagcgaaactcttagataaaacggtgttagcgatgaccgacagccaagctaaagatgagcagagtaaagaaatcagtttattgcgattgtatgcgaataagtttgaagatgcgttagatttagcgttggaatacgttggattatggttaggtattgatgatgttggtaaggtagagattagcggtaatattgatgacgatctcgatccaaatgcctcgatggatatggtcattaaaatgcaacaagcaggcacactttcaaaacaaaccgtctttaatgaggcgaaacgtcgtgggctgattagtgataatgtggaatgggaagatgaacaggctcgcttaaatgaagaaggggtagattatggccttgagttcgcaggacaaaccgaaacaaagcctgaatagtcgtatcgcatacgcattgactgatcgtaaaattctgcattttcgttatgatgcacatcttagacagcaggtgatgaaacggctaagtaaaacacaacgtgagttgctcaatcgtttagcggccgcaggtgttgatgcgttgcctaaaaagcaattagacacactacttaaggagcttaagcaagaagttgcaaaagtctatcaagaaatgaccgcttacacgcaagacgagttaagcggtttttttacggctgaaaccaagcatattcatcagctttataacgatgaagtcggctttgatttttttaatcaggtgcctgaatacaagcaaaaagcgaataaaaccgcaacgattattgcaggttcacctttagaagactggtgggcaaagcaaggcaatgattttgcctttaagtttgagggaattattcgccaagggttgttagatggtcaacaaacaagtcaaatgattaccgatgttaagcatttgatgaatacgtctcgtagacacgctgaaaccttagtcattactgcagtggctaaagtggcggataaagctcatcaagccttaagagatgaaaaccttgatattttggcaggagaaaaacacctttccaccttagacacacgaacatcaacggtatgtcaattaagagatgggttaatgtgggatttagataaaaagccgatagaccacgatgtaccttatcaacgaccgcctttacacccacgttgtcgcagtattttacagcttgtaaccaagagctggaaagagcttgggattgatgcggaagaaatgccgtcaagtacaagagcaagccaagatggccctgtatcagagcagattaactacgaaaattggttgaaaagcaaatctccagggcaacaagatcaggtattaggcaaaggtaaggcggatttatggcgtagaggcgtgattacttttgcggatatgttggatcagagtgggagaccgttgacgttaaaagatttaagttatagatttgatccaaattatatttatccagaagttgatacatttgtattaaaagggacaaaatttacaagaaagcagttagatagaaaatttaagcatattgaagattttggctttgataatactaaaaaaaatcctaaaatgctgaaacgataccaagaatcaattattgagcatttaaatgatgttgaaacaattgagtttgggcgatatagattagagggttcaagggttttttacaataaaatcactgggatggcggtagtaatagataaagatggaaattttgttactgcgtttattcctaaagatgagcccgatatgaaccggtttcagttatctaattatttgaaaagtggatatttacgatgacaaacaaagaatttgctaaacaagaatgggataaagctgctaatgcggtttcttatttgaagtcatctcattcaaaattagattttaagcagcattgtattgatcttctagatgggaagaacagtgtagattattttattctattgataacttggacttggaataatcatcttgttgaattaaatgggcttagcggtttaactcattgggctatttggacgtgctgtgaagattatccgttatcagatgatgacgagtatccagtgtaccctgcaaatgttggtgaatttaaagaggctgtacaacttgctttagatgataattattatgctatttgggaaagactaggtctaagcgatcaggaaattaaagatctttctcaataaactatttctactaacctagcctaagcgctaggtttttttatacctaaatttcaactaaaccgcttatacagcaatgtgtaagcggttttttattgcctgcaagatagaaaagtacactcgacaagtagcgttagtctggcacgcacaattcgagcgattacagcgcaatgaggttctttcgcaaggtattcgtgttatacgaataccttcaaatggtggtgaacaagaagcggtttgtttaccattgcactatctcaatgggtggctatttggggtcaaagtttccaaagttaagccagaattaaaagagaaacttattcgttatcaaaaagaatgttacgaagtgctttgggattactggactacgggcgtagcgaagtgggatgaaattcgacaacggcgagaagttctagaagaaaatgaaaacgcatcaaaaaaacgcgcaagcgaagcaggacgagcattacaaaaacgaaaattagaaaagcatacttatgaaattggtatagcacggctagatagaatggaacagttattacttgatatttaaggtgtgattataacgatcgcaccttttttattacatgaaaattaaccgcactttcgcaagatcgtgcggtttttattatccacgtttcggaagaaacacaaacttacttaggaaggaaatccaaatgaaattaaaacttgatgaaaaaggcaatgttgtggttgtagatggtaaacctgtgtatatccacgatgacgggaaggaaatcccttttgatgcaccgcaagcaatgcagaaaatttcttcgctcaatgctgaaaacaaacaacaccgtgaggctaaagaaaaagcggaagcagaactcaaaaagtttgacgggattgaggatgttgcaaaagcaaaagaggccttaaaaacagtggaaaatcttgatgctaaaaaactgattgatgcaggtgaagcggaaaaggttagacaagaagtgattaagggctatgagcaaaaactggcagatgccaaagcgttagcagagaaagtacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagggattagagtgtggtgggaagcgaaagtttaggagttaagaaaatggcaaaacaaccaacaaaacccgagtaaaacaaccagcaaaactgcgttttaccacggaagagcaagtgcaaagtgcgattaaagagatcggggatttaagccgtgagcatacccgtttaacgacggagatgaacgatattatcgcagacaccagtgagcgttacgcccctgagttaaaacgtttacaggcagagattgagccgttacagcaagcggtgcaggaatactgtgaagctcaccgtgatgagttgacggaaaacggcaagagtaaaaccgctaactttgtgacaggcgaagtgcaatggcgacaacgaccgccttctgtggcaattcgtggggcggatgcggtgcttgagtttatgcagcgtatgggctttgaccgctttattcgtaccaaaaacgagatcaacaaagaagccctactgcttgagcctgaagttgccaaagggattgctggcgtgacgattaagcaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatcaactaatttttttgtggcgtggacttctttctgcaaggcttcaattcgctcattttgcgaatcaatcttttcatttgctgacgtaaccgcttctaaaatcaggtctaatttttccgaatctgtctgtttttgctttctgcgactcattgcttgtccgcctttttatctaatttttgattaacttcttttagcccttccaaaatatcatctagtttttcttttaagcccttattgacttcttgagccagctccttagattgatatttttgctcaatttcttgcttcaactctttaacactttgttcattgcggttaattcggtcaaaaattaccttggcactaaaagcaacaaggggagcaaccacaaaagagaccaacatctgaaacagcttctcatcaatcataacgcccccgttttgctcgaccgacaggggattgattaccttgttttactgccatttttaacaaatcacgacgagttgccacagctggcttctgttttctaaaaacacgctcacgccaccagctacggagctttttgaatagtcttaccatgacaaacctcctcataggtcagattgtgtgccagcacttgacgcttcgtctccgtcgtatcctgacgacttgggtaaatcagcccgaacgccgtgcaacctgtcgtcgtcacggaagtaaccgtgggcgtgcaactgctggtcaacaacggaagcattgctacgcttaacatcatcgtgatttttctgcttaatttgtgcatttttgatctccgttttttgagcctgaattttgctcgcttgttgttgattttctgcttgtaacttccgattacgctcttcagccttttcaacttttaaccaaagccaaaacaaagcacaggacgcaataaataaaacaatagtaactatttttacagtcatcattcgctttctccttggcgtttaccgcctattgcattagcaaagccttttgtcgccacgccaccaccgcaaaataaagcaaataccgtaaacagctccgcaacattcgcacggtctaaataaaccgaataagccaaaatcccagccattaaaatcgcaccaaaaaactggataaacgccgtcgtagataagcgtccgttatcgtttgtgattaattctttaaatttcatttttattcctctatatcattccccctctttgacaaagagggggctagggggagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgcgtcagccttttatctaataaatgcgcccctcccggaagtcggggtttgttgcacgtattagctctagaattactacggttatccgagtagcacgtaccatcaaacaaactataactgatttaatgagccattcgcagtttcacagttcgaattagttcatacttgcacatgcatggcttaatctttgagacaagcatatgactactggcaggatcaaccagataacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatgaataaataagaatgtgtaaaacatttttgatagctccagtgaaaatttatgaaggctaccgctaaactttccagggtttgggcggtaacgtgtaacgggctggaaaactgcgatcactggaacacagcaaagggcgaaacctttcccgttacacgttaccatagatagacgctctaggcgttctttgggtgtgcgtgtgctacgaataaaaaaacacgcttggggcgtgctattcgccagtgataaatcattcgggtttccaggctcggttgtagattttgatacaacgtgggcaggataaacctgtgattttgatttgtaaagtgaaaataattcatttaaaagtgtgttttgttgaatgtttttaatgttcattgtataatgctcctgcatcttatttaagtctgttgatatacttagccccgtttgatttcattcggggctttgtttttgggttaatttgattttagtttgatgatgaaatatgctaaggcatttagagcttcaggcaaaagccataatgccaacgctaccgcaatgccaataccgcaagcttgaaagaagaattttaagcctgatgatatttgtaaccctgctttgtctgcacctgcttcgctcatatttccccctatatttactgtcgttaataagttgctaataaaccgaacaatgctataatcttgtactgatgtgttcgccttgtgcggaattaaaagctctgaatggttgctcgtttggagctttttctttttcgtcattcgcaccccacattacttaaatctctcataggcttgttgttcttctgcttgggtgagttcaccacctttcgctttataaatcgctatggtttgctttaactgctcacggttggcaagttcatagcgataatagccacctgttccatctacggttttttctcgtgtgcgttttactttccctgttaaatgtttacgttcaagtctgctcacataatttcgggccgatgtcatattcatagcgtagccatcaattccgctaatgcttgagaaaattaaacggcgtaacactttaagaaattgtgttgcttttctttccatgcattcccccttaagctcgttttgcttcttgtgctgaaatccacgcatcaatttctgcaagattccagcgaatatgatttttagaaagacggatcggctttggaaagctcgcatcttcgttcattaagctgctgagtttggtacgtttacagcagatctttgtcataacatcttgagtagaaccccagactgctttaactgattcgggttttggtggtaggttgatttgagaatttggcatttcttgccctccgtaagttgaaattggttatctttgtttgttgctatgtagcggaaggcattttaggaaggtaaaaatggaaaactggaaaattccagaattttccagttttgattagtttttagtcttgtgtgtctagctctataccttttagccagttttctagcgttttaccgctgggaagatgttttactaagccgtgtaactcaaaatctttttgaattttaccatcacggcttctttcactcatattaggatcgtagatatgtgggcgtgggttttctgcaacatccgcaccgtagtgaatacgtaaaagggctttgataaattctttttgcttgttttcggatttgctactgatgtttgatttatccctaatatctttatcttgtgtagcggttgttccaataatcccttttagtgataaaaattcattaaagaagaatgtagtattttaatttgtgaggggaaaaggtattttatatttattgttgataaacaaataaacaaatccttatattctgatttttgtgatgttaatctaaaacattgcggtaagtgtttataaagaatgtttattttatcttgacttatatcaatattaaaaaaatcatcacaatctatttctaatttgtttttgagttcattatcatcaatatgatatgcgtcaaataacaaacactcttcaaatgaaattttgtagttattatattcatcagcaatataattataatttaccttattcactttgttttttatgatgtttaaatgaatgcttgccgttaattctttatttactatgttctgaatcaagtcatctactgtaataattatattatgattaattgtaaggtaactaactacttcttcaagcgtataatatttcttagaaagtatttttttatctgtaacttcattcataaaatgcccctttcgcatttgccttatgataggaacgcaccaacaagataaggtgtcttgctttcggtgatcagcctaggtgcgttaatttggtgaattgattactgttattttattcagttaaagattgattttcaatacgattttgtataaaatacttccaatgcttgaataaagcagagggtaaattatttttgatagctaaaagcctcgtaggctgtgtaatgggttgcgttaaaaatatctttatccgagtctgtaatcaaaagccataataaaaaaaagcggtgcatccacaccgccttttttatctccaccgtttcatctcttgatacattttctgcaaatatacgcctttaactttggaaattgttttatcttcccctgctgacttagctcttgccataaagtgagaaccacgcatttttttagttccacgatcaagcataaaccaatagaatgggtctgttttgtctttggtgtttgcagaaacgggagccatttttttgcctccagctcgtctaattctaagggtaagtttaccagttaagccaccactactatttttcttaactctaattctgtggcgtaaattattttttactgtgcctttctgtcttgtttctgtgctttttcctaatactgggataagaggtttggctatttctttatatgtcttagccccttcttttaatgcctctctcattgctgttttctgtgctttttgaatatctttttgaagagcatttatttgttttgataataattctgcaaaaccagccattattttttctcctgtttatttaatatgtttaatgctttatttaggcgttttaatgttatttcattgccaatcgtaggtaagactaatattaatgcttcaatctttttaattctctcttttaaacatttgattagttcttttttataataaggttctttatcactccataagctcataaatgtgaatgtggttttgttacctgaaatataatgttcaatagcaagatccattattaaagggttatttttcgcaatttcgcatttcatttttataaactcccatagaaaagaataatgtataaaatcactgaataaatcattaagtagtattcttctaatctcataaatcaatcccattaaattccgccaatgcttgcttttgttctgccgtcatttcaaaggctaaatcaccatattcaagttgatatgttcccaacgccattaaaaaagcgattgcggggtcgattttatttgccgattttttcttgttcggcttgatgttggcgtttgcgtccgattccatcaccacatttgacaacgcccacgcaagcacaggatcgccattgtgttctatcatttggcgattaatcagcacttccgccgacttcgccacagggctgtagcgttggtatgtttgtggaaatggctcaacttctaagccgtagccttgtagctgtgtgcgtagatgtgtggcgttccatacatcaaagccgatcattttgatttcaaacttttctgcatcgttaaaaatatcatctcggattttgtcatagtcgatacagtcaccttttgtcactcgtaaccagcctaaacgctgccattgttgatagatagcccgatttttattagccacgttctgcagttgatattcgggaatgtagtgccgtgtaagtagccttactttgttgttttcagtcgggaaaatgtaacaaaggctggtaatatcattcgtagaagataaatcaagccccatatagcacgccttaccgtgtaagctttcttcttcatagcttcgtccgcacgctttccagttgccttcgcctagccacggtgtagagccgttgcaccacacattaaagcgcttagtaagcatttccacccattcggacggaataccacgagcttttgtgatggtgttctcaaaatctttataggggattgatttgcctatattggggtttgctttgatccattgtgtcgggtcgtctacttcgctttcatcgtccagttcgtaaatcagaatgaagatactttcgtttttttctgtgccgtctaagatttggcaacagtaatcataatgctgtttacacgctgaaatggtgttactgcctgcggttgtaatcgcaaataaaagcccttcgggtcttgccccttgtcctaattccagtgcactatatacgctgttatcggcgtgtaggtgatattcatcgacaatcgcaaggcttgggtttgtgccttcaatggttgatgatttactcgcaagcggtcgcattaagctgtttttttgcagaaatagcattttgtgctgttgaatggttaatcgcttgcttagtggtttggataacattgccattttctttgcatcatcaaacacaattctggcttgatctcggctgacggcggcggtgtaaatgtcttgttgtcctttttccatcactaagaaccaattcgccagtattgcccctatggtagatttcgcattttttcgggctacctgcacgtaagcagagcgatattttcttaatccgctatcacgatatttaaagccgagtagattcgcaaagagaaagatttgccagtctgaaagctctatcggttgtccgtataggtgtcctttaacgtgtgggcatagattggaaaacttgatgaatttctctactgtttcgttatcaaaacagtagatagggtttgctaaatcagcaaaatagcgatctacggcttgtttgatacgcttacaagctacgatttccccatttttaaccgctaaagcgtagttattccattcactcataagctatttacatcgttaaaatttcgttgatttcgtccgtttcttcggtgtctattgggtttttttcgtctgcttacggggtcaaatcctagcaaggatgacattttaatgatgattttttccgcttcgctttttgcagtaagtgcggggttgcgtgcttctgtgccttggctgtttgtaatgctgaagccacgttctgcaatatcttgaacggctttgcgataaaggctgtaattcacgcaataaagttctaggttggtgtaatcttcgctagtaatatcaccacgttccgccaacactttaatttttaatttccattgctctctagcaatctcatctaaataacttggggcttttggggtttttgttgtcatttgctattctcctttagttccctactttttcgggaattaaatccctattatttcgggaatgcctatattttctaaaaaattgtcgtgcgtaaaaattgagtggggggcggttcttagcggttgggcttttctttcaaaaactccccccacctgttcaatttctttataactcattgattttaaagcaaagctcaaaattgaggagatgtttcagttatggtcatatgaccacaactaagtaggtattcgtataacacgaatcccttacaacacatcattacgctgtaatccgttgtaggtgtggtgctttgccctataccttttacttcttcgctccatatccacgcttatctatcactcttgtcttgtagctatggcaatcacgacataatgcttggtggttgctcattacccaaaagagcggatcagcttgcccattctgtacgggcttgatatggtcgattactgtcgctggtgtgtagcttcctttcgctaagcacatcacgcataaagggttatgctttaagtattcggctctgtacttggtccatctatgatcgtaaccacgtttgcttgcgggcaatctattatcttgcttcttctgttgatgttcttcacatctgccagccttcacacgattacgacaaccagggaaagagcaacgctttaaaggttgcattggcattgtgtaccaccgttaataaattgctacttctctgtatggattccataatgctttaatagcgaatggaacttcatgcagttgaacatcgctcacggtttcacggttcgcatatagatgcccgataaacattaaacaaccaaccttaatgccattcgtaaactgtaccgcttcggctgtggttgattctccccacgttttgccgatatggttctgtgctacttctagggccgtgtccgcatataaggttagtagttcatcatcaagatcgtgctctatgcgtaaatgggctttgatttcatctaaatctatttcaggtttaaccattgtgagcttctccttccttacacattaattgcagttcttgatgttgctctttgctgtcgataacattttcaattttaaaaattcggtttccgtacttaacccgcatttttctggttacttcaagatcaggctgataacgcattcttatccgtacaacggtatcacccatctgaaaaacgccactgaaatattctcgcccttgaataggctcgatacttgcccgtagggttttaatatcttcccattcgttttttaaaacagagccattacgaataattttcccttgttcattgggtttcggtttggcgatttgctgcagtgtgattaccttgtcataagtgccagccttaaccattcttgccatcttcaccgccttttttaacttctactgtttgcttccacgcttgactaaattcatcaccgccaacataaggaagtaacccctcacgcttacgggcttcatttgggctaagaatgccgcatttgattgcggtgtcataactcgcaaagcgttcatcaaggcatcttttaactgctgttcaaaattgactaaatgcggtcttaaggtttgccccaaaaatgctcggctggcttcgctgaaattcgcataacttgaatgcgaatagtcctgtaagaaaatcgggctaatgttgaaaatgcgggcaatatcttcaatagtgaattttctactgcccaaccattccgcatcttgattactcatccctagctgtttgtaatccattccaccttcaagcagtggagtcttgcccgcattcttcgcaccttgatagcgttttaaggcttctaaggctttttgccctttggtttgatctaaccattcggatgttgtgacaataccgcccgccattaagccatttttcattaccgccgatccgtgtcgctgttgggctaaccctaaaccgacggcttcacgacaaacggtaataggtgaacgccccataaagccatcatttgaagcgtgtcgcaaatgtaaaatttcatcttgaaagtagttttttactttgccgtttaggtcggtgatttggtaaagataatcgccttttagtgttcgctgaacattgacggaatagggtgggtatggcgttaatgtttcaggctgtcctttgctattccaaccaatcaccgcatacgcattaccatttaaaagcaagtggcgcatcatcacttctttaagctggtatggggtttggttacggtttggcatttcattaagcagatactcaacactatgattttctatgcgttttcgcccatctgcagttatttcaaacaaatagcaaggcatagatgccaccgcttgagcaatcacatttaccgcatttaatacagcgggcaacgcttctgcagtatgtgggctaacaaattcccccgcacctgtgttagttgctcccattgttgccatcacttcatcaatagataagctgcgggtttcaggctcttgcttcttcttgaaaaatccgaacatctacgcccccagtaccgctaaccatttacgacggttttcatcttgccaatgtgtaaatttttcgccttttgctaccgcttgagaacgttttaaaatctcaagacttgaatcagggtaagcgggaatgcttgttacagtcacctccaccagctccgcttgttgtacggttcgtaaatttggctctacggaaaaatcccattcattttttactgttctgaagccgaaagacattccgttaatatcgccacgttctacgctaaccaataaatcacgccctaattgtgtgtcgggtggaatcagctcaaaacgtaaccccgttgcatcttcttcaagtgttaatgttccgcttgatgttctgcctaatagttttgtgtggtcgtgctcaaacaacgcccgcacgtccttaccactttttaggctgtctgaaaaagcattcggggcgaatcgttctacatactcaccccataacacttcgctttctttattccactgcaccacataacccactaattttttattttcgccatcggttgaaagggttgtggatctaatttctaaatctttcattattgccaccataaagacaaaaaggggctgttacgcccctgtaatggattaagatactttcgcttctaacactttgatagcatttgaatctaccacgccaccgccaagatatttatccgtgtggattttatagaatcctggttctgtgattgcatcaggttttgtgcgtgtgcctgtttcgtgatcgacaatcgtatagccacgtttaaaatcacccaccgctaagaatggatttgtaccttgagcatttggcattgtttccacatagtaaacaggtaaaccaagaagagtagatggagcacccacttgtaaaccatcacgccaaatataatcaccattgccatttttgagcttctgtaaagtgcctgctgtttgtgagttcatcacccataccgcatttttacggtatttgctatgcaatgaataaagcagatcgattaatgcatctgcatttaatttagatggaactacttccattttttgcagtgtaccgaatgggcgggtcttatcgtttgctgtggtgcgagggtaagctaagaagccttttgcctgttttgtacctgtaccgttggttaaatccgtttcttcgatttctgcaaaagattctgtgatttcatcagtgagccagctaagaatatctacgctgccaaaatctaaaatttcttgcgtggtttttggatatgcatagatgtattgaacgcatttctgtttcaatctgtgctttttgctggcgtaactctaataattttttgaacataattattcatctcctaaattggatttgtttagttgttgaaatttatactgaatacggaaggttaaagctgaacttacccacacattattttcagtgtcgtattcataatcgtaagactgattaaaatcagcagttagagaaaagtttttaaagtctttgaatagaatggcatcattaattttttcgttaatttcatctagcttttcttccccttgataaaaaggtaagtaggtcagaatgattaaatctgcagtccattcagaatgcccaatagtaacgggttcacctgaagcatcatttaagtacactgcaactaaaggcaattcgttatcagtgtcgataatcttcggtaaactgttatgaaagtaataaatttcctgtaaatgctctgtcagaaaatcaattacttcttttctaatttgattgtgaattttcataaaaaccctcttaattaagacggcttacaataagcccataacacaatatataggctaataactcgttgtaaagtaagggaatttttatagttaggatacgaaaataaacgatagctaaatttacaaaactctaggaaaggttaattttgagaaaatttttaatcactagatttagtcacttagtcacttaattatcactatcttagtcacttctatttattctttatttttcaataagttaaaagaaaaaataagtgaataagtgaataagtgactaaatttttaaaaaaattatttttttatgaaatggtgatgaatgggaaagaaaaaagcccagcgggtaggctaggcgttcaaagttatagagtagattttatagagcaccgttctacataatcgccccactgttgcatcacttcgattcgttgctcaaaataatctgaacggttgtaggcttttcttgtttgatctgcgatgatgtgagatagacaagcctcaatcacatcataattaattagctgttcatttaagtatgtgctggcaatagagcgcaatccgtgggctgttaatctgtctttatatttaccgccaacaagtagctttattgctctattggctgtctgtgaactcattgatttattcggatttgttccgctctggaaaacaaaacgcttatagcctgtgatgctttttattttttctagaagggtgatcgcttgacgagataatggaacagtatgcgaacgtttgccgcctttcattttttggggctggaatagtccacgtctttttagcaaaatcaatttcttgccattcaacagatacagcttctcttggtcttaccattgtgagcagttgccatttaatcagaattttgacttgtatcgagctattactatcatctaaatcagataaaaattcaggtaataattcagggcgtatggtcgggttattttctgcagtatgcgttgagaaatttgcagatacattcacgcatttattaaactcaatcaaccccatatttacagcaaaatttagcacttcattcagcaacctaataacacgatgcaacgtatcgcctacaccacgctcttttagtggctcgacggcttttatcaccattttaggggtaatctctgaaacggccacattcccaattttactaaaaagatgattttccaatcgggcccaattcttttccattgtcttaggctgtacttctaacgatttcttttcacgccatttcttagcaacagcttcaaatgtgttttctctttttgagatttcttcatctacgatattttgacgatgaactttaggatcgatatttttcgcaagtaaagcacgccattcatctcttatcagtcttgcttgggctaaagaaatttcaggataagcaccaatacctagatttgttcgcttgggtggagtagagaaaggtttatagtaattgaaaagccaaaattttttgccattggcttttactcgtaaaaataaaccttgcccatccataagactataatccttatctttaggttttgctttttctacttcagtattagttaaaggtttggtaattcttgccataatttaggaaccttaggaacacaataattttaggaacacgaaaaataaaaacgctgcaagccttatctatcaaggctttcacgatttttaggaacactggattttcaatattataacctgtgttcctaacggtgttcctaaaatttgcgattaaatacgaaaaaagacgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggcgacggttgaaatagcattaccaataaatacccccacagcttccccaacgcttcttgccccaccttctgcaacttgttcaagtgaaaataagttgcggaaaaagtctaaaacaggcgaaacaatcggacttaagccattccaaatagatgaaaaagccgaacctatactttcaatcgttggttttaaaggggctagaccttgcgatacaccatcaataaaaccactaaagaaggctttaaggggttgccaaaatttatagataactaagccacctacggcgattgcagaaatcaccgcgcctacagggctaaatagcattgctcttcctgcggttatcaccgttttagcaaaggatttatatccgccagcggcaaatgctgtggcaagttgtgttttccccaaccctttgactattttgtcaaatacggttgctttaccatttagtttgtctaactcggcaagcgcttttgttgccttaaaaagacggattggcatcaacatacctgatgcaacagtcgctaatccactgaaggcaaatttggcaatataaatacccgtactcagtgtggtcatacccgcggcaagtccaattgcccatttgaccaattgtttatttttctcaagccaaggcgtaaggctattttcaataaagtcctgcgcgatactggcaaactgtttaatatcatcggcaaaggcagatccaaatgtgccgacagcactatcccaaacaccgccaagagcttccaaagcagcaccaagagttttcgtttttttcagcaatacgatcttgtaaacttgcttgctcacgcatcttggtgagcatttcctctaaaccttttttcccttttttagccaaaatatctgcaagacgaccgccttcgataccgaacaactcttctgcaactaaaccaacaccttcatcaccaaatttagctcgaattttctcgaacttttccatttcagtgagcattgcatcaatgcctttaaacttgccttttttatcccagaactcaaaactcaccccagccgcttttaccatatcctgagcttcggctttcattcctttggttgcggctcgcatcatcttcggccctttattcatccgagaaagcatcatattaaatcccgtaccaaaggtcgaaccctcaagcccttgaacgcctgccataccttcaatagcaagaattttttctgtgttttctgctccagttaatccgagtgaattgactttcggggcgtagtatttcattgactcatagacttgctcttttcttagccctgaagcaaacatagctcgttgcaaataatcagctgcctttggtaattctttttcacttaacccgtgagactctataaattttgcaagaaattcaccaccggcataatgatctttaatatccaataaaatgtttaattccgcggatgttttaagtgcaccaccgactaaaacatcatcagaaataccttgtttttttagagcctcagcgagttgatagaaatcttttctcgttcccggcagatcttttcctaattcacccgcaattttgcctatttcattgaatttaccgatagtcccatcggctttcatcattgcaattttaagattattggctgactcttcttgttcaataaatgtttttaccgatgaccaaacaggcattgccactgcagcggttgccgcagtggaattaaaaattttgcctttcagttcatctctatgggctttgcgctgttcttgtcgttcaactgcttttgagagtgtttgttgtgcggcttccgagcgcttaatagctttagtaaaaagctgttgtttttcaacggctttactaatgctggcttgcactttctcataacggcgcaccaacttggcaacattttcatcacctgttaggtaggccttggatattttctgttgtaaagcaatttgtttttcttgcgacttggcaatttttgagcttaatttttcttgagtttgcatagccttgcccaaaccattacccagttcatcaatggtttttcgcgctttgccaaatgctgcaataaagctacctttaagggcagccccaataaccaaaccaattgctaattcatttgccatttaagttatcctgtgataaaaatagaacacattgagagaggagattagaaatgaaactgcgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcttgtggaatattgctcatagccgttgttgcagcaatacccgcacgaagttgacgcccttctctctctaacttcgcacccaatctatgtgcaacattatacaactggctaccattaatcgcatcggttgaagtagaagaaatttcccctgctgcaacattttggatacggcgctcatcacctgcagcacctacggaaaccacaccgtttgcggttgcaccagcgaagccatcataaatcatgttacccaccgttacacttgatactgtaccagtcgatcctgctgtagtcgttgaacctctagaaccatcttgtttccagtttttgagagagcctgtttgactaccatcaccagctgtagccgtcgtattgttacctaaataaacggaattctcaaccgtcccttcaggagttgcagacatccaagttaatgcaccattactatcacgcttattattcacattattaccaagaacaaaggtattgcttgatgtaattacattatcattaccgaatgcatagcttccatcaatgcctttatagattggattacctgcactgtcagtaccaatttgaacaccacgaatgatattcgggtcaccaaacgcacctgatttattcgcaattacttggttaccagtaccgatagcaattgagtttttacccgatgcggttgcacctttacctatagctaatgcattatcacccgccgcaacagctttataacctatagctgttgcataagtacctgaagcacttgagtcaatatcgttagatgcttggttaataggctctgctacaccatcatttgtatggaagaacttgataccttgttcgttcatattatgaatcgcagtaatcacagagtttgtaacaaactcagtttgacctttcacgttgtaagtggtaagtgtgtactctttagcttgtacaatctcgttaccatcagcatccaattcaggattgccattcttatcgcgtttaacttcagtaatgactgaaccatctttgtccttagcataggttactgtagaaccatcttttttctgttcaacttggttaccattggttaaagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactttctgttgaaagtgggggtatcttaaactgaattgggagcggttgtcaatgcggttttttaacgagaaccgcaaaactcgccttacttgttaccacaacgcataaggattataatttgtacaaccacaacgtataaattaggatttgttatgtctaatcaaaagccatctcaaccaaaaccacaaccaaccccatctaaacctcatcagcctgcttataaaaagcccgaaccagtgtttgtaggtgatagtgtagatattcctaagaagaaataattagggcaaataatgtagtaaacttgaactaatcaccattaataaaatcggcaagctgatagcagtcataatcgctctatcagtatatttccggtatatagcattggtattaagcaaagataaaatagcttggttgatgttatgtaattcatagcgtcttagtatgccaagtttatttttatcttggctgtttttgaatgattcgttataaagattttgtggaatgtttgttcccatttgtcgtattttacttaataaaacgtaatgagttagcataaatgcggatattgtccaacccgccattagtaaaatggcattgacaataataatgggatgtattttatcaatgctgtttattagcagtaatgagatagaaccaatacccaaaagcagataatttaataggcggtaggctttttcccgattgttttcgtttgatttttttacatcgtcataactctgtaaggcttgtttttctaaatattcaagcatttcatcatcaacatctaaaaagtaatcgtcgggtaagttcattataattctccaaatatttagttaaaatagctgaggtgctaaaggataaaaaagattagtcatcttttaattttccatctagataatttagaacccattttacacagtataaggcaataccaatataaacaagtgaatatataaatgttgaaaatgtcattgttgaatccttaataaaaaagcccacgttttgtgggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtgtaataaagcttgtttggtttcaagtgcggtgagttttttctcatctttttccatctcaacatcacggaattttggtcggacattgttgtaatccactttgaatttcaacactttttcatcacggattgcatcggtaattacataagaatgtaactctctaccaaaaacgctggcggtcgtttctgcacctaacgcattttctgcaaatataggtgtgcccgtaaaaccaaattgacagaatttcttaaactttttcttcaaattcttttgtgcttcgccaaattgtgaacgatggcattcatcaaaaataaacactacgggttgttgataaatcggcagattatcttccgatttcattaggttgtttaatttttggatagttgtgacaataattttattatcatctttttcaatattccgttttaaccctacggtactttcagagccatttacactgtcaggtgaaaaacgttgatactctttcatagtttgataatcaaggtcttttctatccacgacaaaaaagactttatcaataaaatctaattcagtggcaagacgtgctgctttgaaacttgttaatgttttaccagaacccgtggtatgccaaataaatccgccactttcggtattgttccaatttttcgttaaataggtgttatttattttccataaaatacgttctgttgctgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatggtgcgttgatttgctacgctggctcaacgctaagcctcgatagccatctcgtgggtatgcacgaaatggttaaatttattacttgcgtttgtgctacctgattcactgccagtgcttaacctttccacaagtaatcacaccgcttgagctatggctttcacatagcttgttgataccatctcacctttggcaagcggtgcgtttttgtctaaattgtgtcgagatgaaataatggaattagccgcctttttggagtaatctacgcattaaccttgctatttttgaaagcgggttttcagggatatatactgaaagatgtatctcgccatcaacggtcgcttgggacattgctttgactttttcttgcgcctcttcaaatgagttggcataaatttctgttgcccacttctttccgccgaagctataagaaacagcatagcatttcattttttcgtgcataagaagttacctctatgtattttcaaattttccaaggtgttaatggtcagtggtattggcgattgtgtcgcgttttgtctagtggcttgattgatattatttcaacaagccatcaagcctattcagataaatctgtttgtgaaattgatattatgaatgtcaaactcacaaatgctacaacgccaattcgttatatttaaccttaagccctgttagagcagggctttaaatccgtatcaactcccgacaactacgtctgattttctctttggctcgaactgttgttggtttgattttgcctttgttgcaagcgtaatttgcaatatcaatcatttttttgcttggtctttcaaggcaggctatatctacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtttttgtgaaaattttgcaaaaacagaccgcttatgtggaagtgcttcctcatcatttctcttcttgctctctgtatcctgccaatatggacagagagatcagcccgcttactcgggactatacaagtaagaacataaatacactacaaaatgcggtgtatatcagattaaccactcctttaggctcgtggtgggtagatgggcgtgtaggctctctgctccatcttattaaacgtgagaaagatttaagtcgtgttggtttattggctcaacagtacgctgaagaggcattacaacccttattagacgacaagcgagcaaaatcaatcacggtaacgcatcatcaagtacgagatggttcaattttgttagaaattgaggttattgataatcgtggtgatacttttaagtttgagcataacgtaaaactaatttaaacggggtttaaatgtttattacaccaactttagatgaaatccgccaagcgattttaagagatgtggtatctcttaacccacacgctgatgtttcggttgattctgacaactatgcccgtgcaagtagtttggcagctaccgcagaggggctttatgctcatcaaaaatgggtaattaagcagttctttcctgatactgctgatacagaatttttagagaaacacgctgctttgcgtggtatttatcgccgacaagcaacttatgccagcggatttggcgctgaagttttggtaatactggagctgtaattgaggttggtaaacagatgcggttttatgaggtggttgaacctgctcagattactcaatcctctgtaatggtcaaagtcaaagcactttcgacgggggcaggtcaaaatatcattcaacctgttactgcgaactttatggcagcaccagttggggtacagaccgcttgtatattgcgtgaaattgtgggtggtacagatgaagaaagtgatagctcactgttagaacgtttgcttaatcgcatcagacgaccgtctgctggtgggaataaatacgactataaggaatgggcgttaaatgttgatggggttgaagctgcatttgtctatcctttgcgacgaggattaggaaccgttgatattgcaatcatcagtaataatgatttgccaagtgatgaaaccgttgctcgtacccaagcctatattgatgaagttcgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcatagttcaccatctttcgggtcccaacagctatgctcttactcaaatccatccgaagacatcaggatcggtcgattgtgcacctcttgcgaggccccaacctacgttcactttcattacgcgtatgggttttacacccaaacactcgcatagacgttagactccttggtccgtgtttcaagacgggcggcatataaccattatgccagcatccttgacttacgtcgcagtcctcagtcccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctataaaggataatgtagcttatcctgtaaaattatagtaatcttaacaagtttttgattaaaaggaggtacaaaccttgaacgatatgtttaaaaatattttgctttgggcggtaattggtattacgttgatgacggctttccaaggctttgaaagcaattttaatagtgcgaatacagtggaatattcgacttttattgacgatctgaaacaaaaccgcctcagagaagtgaattttaagagtaacaatgaaacgattactgtggcaaaggttgatggttcagaatatcaaacggtaatgccgatgtatgaccgtgatttgttaaatgatctcttaaataaaaacgtcaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcagtgtcaatatggaataaaaaagcctacgaggtaggcttattcattctcttgttgttgcttttctaaaacacttgctttgcctcgtccaaatcctgcccagtaaccagcaagtaatgcaccaccgatttttagcatttctaatgcaaaatctgttttatctgtgtacattgcaataaccacaataattgtgataacaacaacacctacaccaattaagatatggcgttgtgaatgaagtttagaaactgcagtaatttgttgagtgcgatcgcctttttgagcttcaatacttgcgagtgcaattttctcattagattcaatgcgtttccgttcaagctctaattccttttcttttacagcctgattcgcttgttgaaccttcacaagatctcgcattgtagcaagaagttgtgcgtccgttggttgtgggtttttattattcattaacgtactggacaaagctgtggcgttttataagtgatttggaatgaaccataaccaccagagccaattttaggtggaacaaaagtaacattctggatgttgttacttactgtggattttctcgcttcgtttaagtactgtttcgctgaaacgttgcgaacctttttaggtacaagcagtggcgttttagtcatatgaaataccttgtttgagtgatgaaaatcccttgtgaaataaggattttatataaaaaaacacattgaggtggttgtaaactttctgttgaaagcacggctatcttaatccgaaggggcggtggttgtcaaatacaaaagcctgcggaaatagcaagctttgtggttattgtttgggtttatcttcgtcaatccatttttctgcaagccattcaaactcacaaaacagtttattgttgttatttttaatacgacgcaattccataatatagggtttcaacgtattccagtcagtgattacgctacttttactcattcgtttataaacggcttcatcaaataaattctctttgatgccaacacaaataaattcaatcgagttgagaatatcaagtacgatgaaattttgtcgatttgtttcatctgttgcttctgcatgtttttcgagggagcaagctaagctcgtgaagtttagccccccatcacgcattttcatataagattttcggcgtttgcggtaataggcattattgctattgctgataagtaattcgatagttgctttttgtttgtgctgttttcgtaattctttcagttgtgaccacgcaaaataggctaggtaacctgtgaataaacaagttcctagccctacaagcagattaatatcaaagttaaagttactaaaatataccagcatttcattggtggtaggttgaggcattaaacttcccatccttcatttagtgaaaaaccgtcccaaccttcgttaattgatttagacatttcattactcctaatttaaaactaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgttgcaccttcaggaacgtgaacgtgaatatcacgtttttcgtggaaatcgctcgcaatacctagtttttcagctcttgcacgcacgaccatcattgccgcttgaatggactctttcatcacatcaccaagagaacctgtgtaagagaacttccctttaccagccacagaagcggtttcaatcgtcaatagatcaccgccaacttccgtccacgccaaacctgtcacttcgccgacacggttctggctatccattttaccgtaatcaaaacgctgtactcccaagtaatcttttaagttttcttggataacggtgatcgatttgagcttcttatccatcactaacgcttttaccgctttacgacagattttcgcaatctcacgttcaaggctacgcaccccagcttcacgggtgtagtaacgaataatgcccaaaatcgcactatcatcaatcacaagttcgccagctttcaagccgttattctcttgctgtttcgcaattaaatgctctttcgcaatgtgcattttttcatcttccgtataacccgaaaggcgaataacttccatacggtctaacaatgcaggcggaatatgcattgagtttgatgttgccacaaacatcacatcagacagatcgtaatcgacttctaaatagtgatcgttaaaggctttattctgttcaggatcaagcacttcaagcagtgcagacgcaggatcgccacgcatatcttgtgccattttgtcgatttcatcgaataagaaaagcgggttcttcacgccaacttttgccattttcatcatcaactgccccggcattgaaccgatgtaagtacggcgatgaccacgaatttccgcttcatcacgcacgccacctaatgccatacgcacatattttctgcctgtcgcattggcaatcgactgaccaagtgacgttttccccacgcccggtggcccaactaagcaaaggatcggacctttgagcttgttcaaacggctttgtaccgcaaggtattccaaaatacgttctttaacacgctctaatccgtagtgatctttatccaatacttcttgagctttttgcaaatctttcttcacaacagaccgcttatgccacggcatttgtaaaatccagtcgatatagctacgcacaactgtcgcttcagcagaactttgtggcattgctttcagcttattaaattcgctatccaccttttcttgcacttcttttggcaattttgcttcggcaattttctctttgagcttatctaattcaccctgttccgcttcttcttcgccacccagctctttacgaattgccttaatttgctcattcaaataataatcacgctgatttttttccatctgctgttttacacggttacggatacggctttcggtttccattgtgtccatttccgttgccatcgctaacaacaaggcttcaaaacgggcaataagattagcttcttccaacaatgtctgtttttgttttaccgaagcaatcaaattcgcagatatcgtatctgccaagcggtcttcaaaggtaattttttgcaattttggcaaaatttctgcagggacttttttattgcttttaacgtaattttcaaattcgttgagtgcagttttggcaatcgcttttaactcttcgttatcatcttgataatcagaaggcatcgaggaaacgccagcccaaaaaccactttcatcatcacgaatatgttcaattttgccacgcacttgaccttccaccagcactttcaccgtgccgtcaggaagatttaacatttggataatatttgccattaccccgacatcataaatatcatctgccgtaggatcttctttgtttggatctttttgtgtgactaaaaacagttgtttgttggtgttcatcgccgcacgcaaggcttggactgatttttctcgcccaacaaataacggcattaccatataaggaaacacaaccacatcacgcagtggaagtaatggtaattcaataggtttcttttttcttgccattggattgctctcctaaaatagaatttgtacattatgggggctaattcgtgaaatacaagggaaaatcagcgaagatatgagataaagtattgtttaaactaaaacaggcggttgaatttgtagaacaatttgaaaatttcctcaaatctaaccgcttgtacatttattaaatgtttaatcaaaacattgataattgactattttgttgatgcggaataatactatttttcatagtttccccctctaaagcattttttatcgctacggcaatttcgaatgctaaattaactggaacggcattaccaatcatcttatatgcatcatttgtatttttataaatgaatttaaaatcatcaggaaagccttgtactcttgcaacttctcggatcgtcattctacgataaagttcttcttttccaacaacaaaacgatagtcgtttgtaccatatttttccattttgggggcttgcgggtgcaattggcattgccttcctgaagcctgaaccgtaaacccttgctcgtgccacgatttaacacgatttcgactcataaaaataggcgaaaaactgcctatgaaatattcattattattgattgcttctggattggtttgattacgttccaaggctggtacagcagtatcttgtaaatcccaaataatatctttgagagatatttttttgttatcatcaactgttgaacctgttggaaactgaaaattaatatctaaatcttttctgaaaccaatataaaacactcgtttccgttcttgtgctactccgtaatcttttgcatttaccatcgtaagcgtaacatcatagccactctcatcaaacatttttaataagttttgaacagcttcattatggcgattagcaagcataccacttacattttcagccaaaaaaaatttaggctgtttactttttaaaatacgaatataatcaaagaaaagctgaccacgagcatcatcaataccacgcaatgagcctgcttctgaccaagattgacagggcggcccaccgataattccgtcaatattatcggggaaatcttcttctttaatatcacggatatcgccttcaattaatcgagtattgggatggttagctttaaaggttgcccaaatagttttatcatattcgttagcaacgggaattttaaaacctgctttttcaaagcctaaatctaagccaccacaaccacaaaataaacttatcactttcattttattctaaatataataggttactaattttgcatttttaagtttcattggattgtttggatcttttatttcaatatccgtaatttttaatcgttcattttggatggataaaagctcatttgtattatcaaaactcttccatttattctcattaataatagccataaagctaaaacgatttttcttatcacgttggtaaacataggaaaatactttccaaggattttctatatgccacattcctctaattcgtagataagtaatttccaaaggatcgacgttatttacacgtccaatttcattggtattagaaagatccaatgtagaaccattttcaatgctatttttgatatcgtttttagctctcaaatagacatcatcattggcacaataatctgcaccatatacaaagcaaaggtgtttcaattcattacttttaactacacctaccaagtaaataatatctttttctatccagttctcagcttctcgacaggcatcagaaatcaatgtactacttgcatacaacttatgtttaggatggctgctatttaatgctaatgatgcattatcactttcaattttcttaacttcaattgcatctccatcttttaacattgcatcaggcggattattagcattcccagtatatgagaatatttttcgcaattcggtttcacgctcgtgaccattaagatgaaagctaccagcaaaaagatcctttgcaaactcttctaaagccttaccagctaaattggctctatttctaccttgatattcatcggttaagtgcgtgataggattatttactaaattgataatagcattgattatgttcattcttacacttcttttgtcaaaaaacttgctataagttaagtatagcaaagatcctagatttctgttactggataaaatgtttaaaatccaatcacttaaaaatgagttccagatatttcgtaagagagaaaatttcgggcaaaatgttgtaaatctacttaatcgatagatctaggcagtattaatgaataaaacattcaaaagacctgtaaaaaatgctatattttgccttaattctgtcacaattttaaagaaaatggctcactatcaagatatttccatcgcattagctggcgtatgccagtctgcaagccttgttcaacaatttgctcataaaggctttgcggatcgtgatgcatttagacactctctttctagtttacttattacccaacctgactcaacacttgatgttttcgggggcgatttagctcatttgaagcaagggttagaaaccgcattagctcaatttggtggggcgaatgggaagcttgacacagaaattggtcgctattggatcagcatcttagcgttaagccaaaagttagctaaaaatccccaagcaaaagcgaatttagcacaacgtttgcaacaacttgaacgccagcttgctctctatgataacgatattttgcacgaacagatgattgcaaatattgcgagtatttatagcgatattatcagcccactgggttctcgcattcacgttttgggtatgcacgattacctctctcgccctgatattcaaaatcgggtaagagcgtcgctattggcaggtatccgtgcagggattttgtggcaacaaatgggcggtagccgttggcaatttttcttttcacgccgtaagctattagaacatactcgacagttatataaatccttttaattaaagagtagtatccgtaataatattaaaatgggctcgttgtaaagaaaatttccttcttcccaacactttggtaactatacctatcttacaatggcacatgttttacttaatcaaacatgtgccattaaaggcttacaaaacactaataccgcttaatctcaaaccccttctgcaatgcttccacactctcaaccttctcaaagccttttagttctgcgacttggctaattttcggatttttaccaacggcttggctggcaaaaacaaaacctgtttggtcgataatggcctgctgatagaaatcaagaatatcttgtttagtgagctgtttaatcaattcaatcacttttgccttacggtcaaactgcccgttgcctcgtgaaaaatcggtgacaaattcagcaaattcttgatctaaggactctggcttatgttgtaacacttcaagtaggcttgctcgatatttttcaaactcttcggcactcattgcgttgagtttagccaaactttctttaaagaagcgttcattgtgttgcattatctcttttggtgaagcggtcgggctttgtaccgaaaattgcaagcctgatgttgtgccgatacgagtgttataggcgtaaacaacataacctagctgtttatctgtacgcagatcatcaaagtaccaacgagagagaatatcctttaataaactcgcacggcttaatccctgtaactcatcataaccttttgggaaataggcgattgttaaggcgttatcttcgtgagaaatctgtttaatatgatttagcttgcgttggctctgattaatgtcgagataacgtcctaaatcaatctggctattttgattgttaaagaccgtttcgacttctgttgcaatctgtttcacttggttatctgaaagatttcctaccgcaagaacgcgtaatgatgtcgctttgttcagcaatttttcacgcatttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatcctttatagccggtcgccacaatataaacttcacgagaacgatcacgagaagcctcaggtttacgcacttttactacgttaaataatgaacgaatttcacgcagataatcatcaaatccttccccttggaaaactttgacaacaaaactgccttttggtgctaacacttgacggcacatatctaacgctaattccaccaaatacatcgcacgaggaatatccacagaaggcataccgctaaagtttggagccatatctgacatcaccacatcaacttttccctcccctactctctctaacaacgcatttagaacgctttcctcacagaaatcgccctgcaaaaaatcgaccccgacaatcgggttcatatccaaaatatcacaagctatcacacgccctttatcaccaatttgcgtgacaacgtattgcgaccatccacctggcgcagcccctaaatccactactgtcataccgtgtttaaacaagcggtcagtttgttgaatttcatctaacttaaaataggcacgagaacgaagtttttgcttgtgtgccttttgaacgaattgatctttgaaatgttctgcaagccaacgagatgaacttgcactgcgttttctacccattctctactctgattatccaaattaaataacaaatgtaggaacacactgcgtgtgtctactatattaaattcaaacggacacacgcagtgtatccctacattgaaatataaatctataaaaaattactctctataataagggtgaaatggctgatttcaagggaaaagttaaaattttgtggcaaaatgattgaatttgcaaaaaacagctcggatctgaccgcttatatttgctcgacaccctaatttttcgttataatcgccacaattttcgccaatttggcatctttttatttaaacagaggacagatttatgggctttttagctggaaaacgtattttagtaacaggtttagcaagcaaccgttcgattgcttacggtattgcaaaagcaatgaaagcacagagggcagaattagcctttacctatttaaacgacaaacttcaaccacgcgttgaagagtttgccaaagagtttggttcagacatcgtattaccattagatgtagcaaccgatgaaagcatcacaaactgctttgcagaattaagcaaaaaatgggaaaaatttgacggtttcgttcacgcaatcgccttcgcaccaggcgatcaattagatggcgactatgtaaatgccgcaactcgtgaaggctatcgcatcgcccacgacatcagtgcatacagctttgtggcaatggcacaagcagcacgtccattcttaaacaaagacgcagcattattaaccctttcttatttaggtgcagaacgtgcaattcctaactataacgtgatgtgtttggcaaaagcatcacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagagttaaaccagattttgggcgaccacgagagcgtttttcagtttgcatagaaattccttgttgatcttttaagccaaaaggcttatagttggagccgtcagggggagatccgaccttcccccttcaggagttaccttaaactaccgtacctgaacaacaggtgagtaatactacggtaactaggattagaactctgaaaatcttcatatcctagctccatttagtggcccagtgaaagctgggcttcttattttcagaaccattccgaaaacaagcatattttaggttaaaccaaataaataatcaagatatttttaaggttaaactaaaataattaatgtttttgtatttgacacccaccgccccttcagtttaacattatctcaatctaagccgtctaacacggctttttttgtatccaaaatttgaggtgcggtatggtagctgaaacacattacacaatagacaaaaatatgaaactactcatcgaaattgataacagtgaaccgctacaactctctaccttttgccaaagtatggaagggatagctgcagaataccgccaatttatccaagacaacaaaattgaaattgagccttgcgaacagcatatttatgtggaaaaaatcacacaaggctgttttctcattgaacttgccgcactggtttcaagcacctacccgataattgaacagggtaatgccattctcgaatttggaggacatctcaaaatgattttagactgggcaatgaataaaggcgaaaagcctgaacgacttacaccggcaatgttaaaaaatgctaacaatattttagaacctatcgctatcgaccccaaagcacaattcaatctacaagtatcgaataatcaaggcgatgtgcatattcatctacacgccgacaatgcaatggcagggctagctcaaaataacattaaccgagaattgaaactcctcaaagagcgtgaagaaaataccttacgaaacaccacgctttattggtcgtccaccgcagacgctcaaagcaaagctcacgacagagccattatccctgcgatttcatcaaagccagtaagagtgcgatttgaagataaatcacttaaagacaccatgatcatcaacgaagaatacccttatcacaaaatcttcttggtggatgtattggttgaatatatcgaagaagaacctgttatttataaaattctgaaactcaatggttcaatgaataaaatctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcagtcagaactagattctagaaatcgtgctactgtttcattgttggttatttcacttattacttcagcatcactgtatttgttgatcgcagaaatggctttgcaagcctttagttccaaaccgtcataatacggagtaattttgatggaacttagaaccgcttctataatttggtgtttttgcaccaaattaacggttgagcttgttacactttccgcttttgagtagttttctgtgttcattttgtttaacctcatttgtttgttaccattcagaaccgctctcagcaagagtgaaaaattcacattaaaaaagcctcttggttagcctgaaagcggttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgttacatcgactttatccttaaacataccaagatgtttacctaatagctcaagcgctttatttgctgcgtgaggctcaaaacaaactttctccacatccataggaacaatagagccatcaaccttgcttagttctgtttctgtgattttctgcttgcctgtactcattgagataatttcaagtaatccctttaaaacatcatcttgagtaacatttactcgcgcagctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggtagtgagggccttggtcagacgcagcgggcgtgcttgtggactgcttggtggggcttgctctgctaggcggactacttgcgtgccttgttgtagacggccttggtaggtctcttgtagaccgtcgcttgctacaattaacgatcaacttagaactggtacggacaaggggaatccgactgtttaattaaaacaaagcattgcgatggtccccacggatgctgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcagaatcagcggggaaagaagaccctgttgagcttgactctagtccgactttgtgaaatgacttgagaggtgtaggataagtgggagccctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataagtctgcgtccacccatccgaataatcatattcaagcggattttctacttgttccaccatcgccttatgcttcaaggcattggcgtgattgcccgttttcgcctccattaacacctgccaaatgactaacaatttttctttattaatcatcgcaacggaattatcggcgaacgtccacggaatttcttggtcgccgaataaatcaaacgtcgctttgacagacaagatgttacgctctgctgttgcgtctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggaagattttgtgattaaaccgtttgagcaggaggcctaaagcccatttaaacgctctttaaatctccccctaaccccctctttgtcaaagagggggaacggtgaaaggggcgttaataatgtgttttaaccataaggggtaaatgatgaccgatagcgaaaaatggcaaataaaagaccgcttgtatgacttgattgagaagatacaaggggcgacggaattagtcgaaatggacgattttgcactggctggcgtggttttgatggacgtagctgggcaaattcagcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaccgccgagatgaaaccaaagatacagcggggaactcgttacagtcagattctgcggattcagctaatgcaacagatgaaaaagtggcagatgcaaaagcagatggtgcggtaattcagccgattgcctttgaaatcaccttaaaggcgattcacccacaagcaagctatgggcgttgcagttatcgctttaccaaagataaagcagtggaaattccgtttgatgccttaacgggtgagcagattattgcactttcgcaagatccttatcttgagcttgtgccaatttgtgagaagtagcgatgtatgccgacattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgctcaggaaaggggaaagcaagggtctttatctgaagcggagatgaaatctcgtttggaacgcaatcaagctatcattgacggtgaaattcgcccaagcgtcgaagcaactacaggggctttatcaaattaccaagcagactttcaggcttttgggcggtctatttctatggcaattgaggctgggcttacatcgcagtcgcataccttggcgaataatatcaccctcgaagtcgatgggcgtgtgttggctgaatatgtgtctaatgagcaatttaattttaataaacgggtggcgtagatgagtggttggacaatgcctgttcaacaggcaagttttaaaggggtgcaatttgatgttattgcggttgatgaaatttttgacaaagccattgcagaacacgcttatccctttgtgaatggggcagatttagaagatatggggcttaatccccaaacaattaagttgcaagcggtctgttttggtgagggctattacaccgattataaaaaattacttaatgtggttcagcaacgtggggcagatgtgttggttcaccctattcgtgggcggatcccaaatatgattttggtatcggcaaatttacgtcacgacgctgaaaatgtgaattatgtggcgttagatttgacgtttagggaggctacgccattaaaaccaatttttgtatttgagcatagtttattggcgaggatagatcgttatcttaatcttgccgataagtttatcggcgatatgttagcgtggtgggcgaaaggaatggaggttatagcatttgctcacaatgctaaaagtcgattgttatcacaatggagtgcgatttttggctgttttgagcaacttaatgccttatttgaattaagtcaaaatgtaaatactttacctgtcggggttagtaagtcagcttttcaaaagcagggggtgcaggcattgcaacttttttatgatgttattttagctcaatcgaaaacacatcaatttaatactacgctaggggtaaaagcggaatttaatgagctaatgcgtgatattgataaggtgttaaatatcccacgtctgttagttacaggacaacatcagcgaattacctctgcatctcagtttttcgcaatgcaaaaaaatggtcggtcggcgataaaaactcgtttatcggcagatgatgtgaaaagcctaaactgtgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattttgcaaacctatccgacaatccaaccgcttgcgtcggttgtgccacacgccccaacaccgcttcaccctcttgagcttcaggaatacctaacttatcccttgcccaatttgcagggatttgtagcccaatatccaccaatttcggcaaactctcagcgaacaacgccaaatctgcaggttctttggtatcaaattcaaacgtcggaatacgagtaggatcgacattcgggaaattaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttacacagaatttgggatagggtcggatagggtcttcgccaaacgttctttttccgcctgttcagccgctaaacgctcggcttcttcttttgctaaacgctctttttcagcttgttctgctgctaagcgttcagcttcttcttttgctaaacgttctttttccgctttttcagcggctaatttatcagcttgagcctgttgttctgctgtttgtgaggtattctggtttacggtgctatctgatgagccgccaccactacttccacaagccgttaagcccaaaagaatcaaacttgctaaggttactttttttaatgacataagagtttctccttgaaataaaatgctgaaaatatccttgtaattatcctttttctaaacaattatttatcaattaaattatttaaagcgtaaatcgttttattgataaaaaagatttatagctattcataatgcagaaatgcactccgaatccgataaaacaggctttagcaaaagattaaaagtcgccttagaattggctgggcttcaatctttgtctttagctgaaatttcaaacaaatttaatcttcgccacccgaataagcccgttacaccacaagcggtacataattggctgattgggcagtctattcctacgcctgataaaatcgaaaccttatctaaatggttaaatattagccctgaatggctacgttatggaaaagagcattttgaaggggagagcctttctcaaaatgaaattttaatgttgaaatattttcgtaatttacctgctaaccgccagcaagcgattttggcattactacacgaatttcataaatagataaaatgactggcgttaattcaacgaaaacagcataattccatcgtttatttagtgagattaatctatggaactcaaactccctcctccattagttgcactgatttgtgcaacaatgatctattttctgccgaactatgcagagccgaattgggtctatcaaagttttgcgataatctgttttatatttggggttagcgtcgatctctgtgcattgtgggcttttcggcaaaataagacgacaatcaatccgcttgctcccaataaaacatcagctttaacaacacaaggtatttatcgttttagtcgaaatccgatgtatttagggttggcaagtctattatccgcttgggcattttggctaggcaatgcgttcgcattgcttgtcgtgtggggatttattgcttatataacccgttttcaaatcgagccggaagaacggattttagaacagaaatttggagagagttatcgccaatataaacaaaatgttgctcgttggttgtaataaataaaggggctgtattagattagccctaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaatgctattttagaagaaaccctgattatcaaaccaagtcaatcagaaacaagtaaatttttactgaaacatttagatgaaagtgcaataaaaaaattaaaaactttagaaatcaataatttagaaggaattaaacattgtgttcttaatcagctcggcattgctattatttcaaaattagctgtagaacaagagcttaaaagaggagaactgaaagagatcaagctcagtagccatcaatttattcgagggattaattatattcaccataaatctcgcatactctcgcctgcgacacataattttttacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagttggcgatttatctggaatgtggcgttatcgtgtaggcgattaccgcattatttgccatattgataatggcgagttgttgataaccgccttagaaatcgggcatcggagagagatttatcattaatcaaaaccgaaacactttttcttattaacaacttgatattcggcttctagcttgtctgtatgctctattagcctaaattcattattattcttatccgattcacaagaaaatagcaatgactcattagctacagatagcataggagccgacatcaagataaatggtaaacaaaattttttcatcacactaatcccgtattgaattgtaatcccgacatactcgttttaagaccataaacagcatcttgagtagtccctgttatcgttgatgcactagagtgtacattaactccaccgttgattacaacttctgtgcgttgattattgttgatgttttgaggttgagcaagattttgcattgtttgtcgtgcttgttgtgttgcatttaaggctgttgctaccatatatccaccaactggagcattccaatcaatagatttgctctgaataggtttgctctgtttagccaactgaatcgccttttgacctgtattatagtaatcagatatttttgttccattaccatctgtactatctataccagagtttgcgaaggctttcgctccgcctgctccttttaagtgagcggccattagtaagccggctttatgctccgctgaaccttgataagtagagcctaaataccccacattcttattcataagagctacgattgcattatcttgaatggctttactactcaaaaatgcctctcgaccacctttgatggtccagttacttgaatccgctaaaaatgctttgtgaacatcagcatcagaaccgttagataatcctttaccatattttcttactgctgctctatatttagcatcatcgattaaccccgcatcaactaatgctgccgcaccgaactgatataatcccaaatatccatattgattttctgctctaaggtttccaccgctttcacgcttgaccatttgagcagctaacgctcctgtttcttcttgtgttagccccttagctgatttctgcccttcaaagacaaagtttcctttgctaaatcctttcttagtatcaacaaacccagcatttttactttgttgagttaatgaggcttcatcactagattgaatttgagcggctttatcaaaagcttctggagctcgctcttccacgccattccaccagttttgaatacttccccaagcatctttcgttttttgagttacccaatctacgctatcactacctaggctctttacttcctcccaagcaccttctaagtcaagcgtaatgattttgtacaaaatccctaaaaggcgatcaaatacaggcattagatactcaacaatgtcttcccctaggtttttaaatcctgttgctaacgagccaacggataaaccgttttcatcaataaaacctttaagttttaaccaagacttaccatcttcagctaaagcattccaatcttcatattctgttaataaataagtgaaaccatctactaaactgcgaacggaaaaattagctttatcaaaccacttaataaaagccccccagttaaacagggaattaccaccctctgcccattttttatagtcatcatagagcaatccgaaaacaccagccaaagcagctacaagtagaattgcaggtaaaaacggagccataaacgctaaagcggcttttgcacctgaaagcaatgtaggaatgagaactgctgtcattgcaccagctattcccataaatacgcctttcacaaggttttcatttcggcttaaaaactcaaagaattttgtggttaattcgctaatggttaataaggctggagccgccgcatttgcaatcatcagttttagtccgtcaaattgctgatttagcattgagacggatttattcagcttcttagaggtttcaatatcgtcttggttggatttgtagattttactctgataagcaagcatctcttgataggcttctttgccttgtgcaagcgtgttaaacgtttcttcatcaatgcctaacccttgcgccataacaagcgctgtgccacgatccattttgctgaacttatccgccaactctagcataatctcttcaagttttcggatattgcccattgcatctaaaggagcaacacctagagcgttaaaaaatggaataacagaagcatcgcccattacctgaaagcgagttaaagcaccagatagccccatcaacgtgttagccataccgctagcacttccgcccattgcttccgcagcaccttgccaagaggcgagagaacggctactcattccaatgttttttgccattgaatcgagttcttgattagcttgagaagtttgcttaactaaacgatcaagcccaatcccagtcataatcattgtgctgatagcaccaagggccttgccaaacccaagaacaccaccaagaagattcttagcggctttctcgttgctttttatttgcttttcgtttttctctaacgcttttgtatgcttatcctgagattttgagacttcgcttgtggcatcgtttaattcagcaacggttgtagatagcccttctacgcttttatttgcttcatccagagcttttgcattgctatcaagttcctgctccatccgctctaacaaagcgagaaatggttttgctaccgcagtaaagctatcattagcaacaatatctatcgcaagcgtatcaattacatcagccattatttgccttcctgttgttgtatgaatctacggtaaatacttcgagcagatctaaagcatcctctaagccgtaaacggtttgtaattcgtggtaagtggctaatttgctactcaccaccgcacctacaacttgacttagattcacatattcgactgcatcaccacctttgcctactccgagatcggggtaggctcttgctccaaaaaatcaatatggagagataacgcctctttgcgtaatagccataaagtcgtaatgtcttgtacatcgccaagggataaatctaccgcacgagtcgcaccgctttcggtgacgatttccacacagtccattagctcatcaagtaacggcaacgccttttcttctgggatttctcttaatgccgataaagccactctagcaataccaagcataccctcttttgcatttggcacttgaaagcctccactcattaaagcgagtaaggcttttgtcgcccatttgtccgctttcgcaataggcatttcggtaattttgaatgtaatacctgcatcacgccctttttcaattgtgattttttttgtttttaacgccattttctctctccatattggttctaaatctcgcttttaagatgcttacaagaaacggtgagcgagagagtaaacaccgctttcgaatgtacttttctatcttgtaagcaataaaaaaccgactttagtcagtcggttaaatatcttcttctgttttcacgacaatcttgaaattgtacgttgcataatctaagacttttttagcactggtaccgctttgggcttgagtcataaaacctgtggcggtatatcgtttaccaattgacggaatcgtaacatcaaactcaaaaggcacggtctcctgttggttttgcatatgcacttttacgccatcaaaaaatgaacggcttggactgtttgcagcaagtgcaatattgaaatcggtttcgctaggaacccaaccaccagactgatagccatctacgcccattgtggtttctgttaccgccgtttggttaaacgtaaatgcgttatctgccgcatactgttcaatctgaacgaaaccacggctatatccaacggcttttgctaaaagcactgcatttgccgaggtaattgttcttgaggtatttgtttgcattattttttctccaaaaagaaaaaggcgacctatttcaagtaagtcgccttatggattagattacattattgaacgttaatagaagcaagatttacggaatgcaagctaccgccgtccgtatagaatagcttcatcgggaatgattcacggtttcctcgtgtttgcgctgtcgctttaccaatgtaaagataatagccttgggcctctacttgtgaagcagcatcaacacccgtgtagttattgatgattgctttttgttgttcgctcaacgaaacacccacttgaatagagccaaagttcaatgcttcattgattgggtcattacacgccgcacgttgcaatgcaataccaatatcattgtaagggactgattttgcactggttagcaatgtaataatcgctaactggagctggctatttaagcggatttggttaatgtaagcgtcgatccatttccattccccagaaatctgacctggagataggaacaaaaagcggtcgttagccgttgcccaagcaccataatagttatagccattatcttctaaattcttagcaattgtggcatcggtaacatcagcggttaatcctgattgacctttaaacttaagcgtaatacgcccttgtttctcggtaaaatcaattgaagctaccgtaccacacaagaatgccgctttatctaaaccaccatacacggccgtcgcaccactatattcagattcttttaacttagcaccaaaacttgttgtatcgcctgtttgtgttgcagtagcctctttaccccaaccaacatacaagaagcgttgattctgattgttagaccattttgcaaactctaatttttcctctaatgtcggctctgtgattgtggtaaatgttgcccagttaagcgttgaaccaatcactgcttgcatggtttctgtcggagtggttgtatttgagccttgtgaaagcgtagcacctgcattttcacttaaccctaaagcatctgcagttgcacctgttgcaaacgcaatcgttgatgttgtgccagtcgttgaagaagcaaccttgaatgcttgtaattgactatcaaaagtcactgttacagagcctaacgccgtaccaattaactcagctgcattagagaaactttttgcaccacttaaattcaatgaatctgcttttttctcactgccgtcaataattacactgagtgttccgttaattttcttgagttcatttaacgataatgatttaacagaagcacctaataagaatgcaccttctattgctttattgtaagcaaagaaaattaacgtaccaggtttaatggttgaaccatcaaaccctttaaaataaactgccgccgcttgatattccgcagaagtaaacccgaaatattcacctacagaatccgccgttgcaaatgaaacagctcgacctgttggtaggtttgcattttcacttaagaaaacggcattcatcgaaagtggggagccgccagaactcaatacggacggattcacattcacaatctgacttgctggaatcgattgaaacatagtttttccttatagttttccaagctcaatgcttgggtttggtttagtaataaaatcttgagcgtgtacaacaacagggttataagcaagccttgcggttactgtatatctttcttcatactcgctcgcctcgttagtaaaaggtaaatagcgtggttcatcgcaataaagaggctggcatttttccaacctgtcgcaagcgtgataatctcgccataaattgcaaaaaatcctcgccatttgaccgcttgtttccccatagaaatctatttgcatttgcacttctacactttgcataacagaagctaatgcgttttcaacatcataggagtgaacattggtagataacgattgctcgtaaatgatgttcatcaaaataaaaggcgagtgcggcagaggcacattattgctataatctcttatcaccctctcgccttctaaagaaaaaagtccaagcaaataagatcggacttctctgtaaatatcatcgtgggttgtctttatgtctgccgccataccaccaccttacaccagttaggaaagctctcagaaacggatttaattagccattcagattcgctctcttcgccaaatgctttaaaaacaagcttatccgcaccttgatttgaaatgcgtcttagcgcgtggatttgccctgaaacatacacattcagcatttgcccttgttgagccaacgtatcaaacaaagataaatcttgcgtactcagactttgagcctgaatgctgactttgaactcttcaaactttgatacacgcttgcctgtgtcgcttgtttcatatcctgtgtttagttttagtgttgcctgaatattggggtttaccgtggtgatatgttggttggcaatctggcgtaaattcatctaccctccatatattctcgaataaagcctatctatcctaatttttagttgatagtccctcaaacgttggtttataattcgatcagaggcgttattgtcaatgtagagagctgtgtcacctacatttgagaaactggcagtgtccgaactcttgcctgtgacataaacgcctttttcaaatgctgttaatagccactttttttctttatcttcataagtcagtcgaacaactccacgatatttcccatcttcagatcttaatgcatcgatacggcttaatagcttatttaatcgctgattaatgttgcttttttgagtgttttttgctaacttaagaatgtcccctacagagcggattgaagtcgggtcaagcccatcagcttgaacagtcgagtcaacccattgagctgtaggggatttttcatttaggttcatataaaatccttgattaaataatcattagagctataattttaaccaatgaggcagcgtgataatttaagaggtaccgcacttgaacgcggtaaggtgctggattattacgttgcttctattctcgcatataaccatgatcataatacctacgtccatctttataatgtttgattgttaatatcattttggcatttttacccataacattcatttcagctttataaatctcaaccgataaaacattaggatcgcctcttttatcttgctttttatgcattaaagtcgctgtttcaattagttcaggtatggcagggatcgttttaatcaaatcctctgctgcacccgatatagtatgttttataccactagcaccgacctgaatttcattacctgtacttaaattaacaaacttctttccggagaaatgttctattgcataaagccttgctcgtgttctcagatctttaatgtcttttgcgttacctaactctttacccgtcacgctaggtatttttgttgcctctttatccaagtttttcttagctgaaccagcccctttcccaaactgaccattttcagctctaggatgtttgctttcatcccaatctttatcacaagcacataaaagcaatagcctttcaatccgtttgatattagtttgactaaaatgcatcaatcccccttatctgtcacgatataggagattgagctgattaatacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttggagacctgatgcggttatgagtacgaccgggcgtggacggtactcggtcctccggattttcaagggccgccgggggcgcaccggacaccgcgcgacgtgcggtgctcttccgaccgctggaccctacctccggctgaaccgattccagggttggcaggccgttaagcagaaaagataactcttcccgaggcccccgccggcgtctccggacttcctaacgtcgccgtcaaccgccacgtcccggctcgggaaatcttaacccgattccctttcgggcaacacgcgagatcgcgctgtctgccggggttaccccgtcccttaggatcggcttacccatgtgcaagtgccgttcacatggaacctttctcctcttcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagactgattaatgaggtattgtcaggcacgtttttcaaaagagtgaacatttttgcaaaaaaattataaaaaagaccgcttgtaaaaacaaaaagagccacagagtggctcaattatgcgtaaccccgtacgcttgcgtgcggggtataaatgctcttgaaaggttattactatttctttttagcactgatcgctttggcaatagaaaaagcggtttcccaagcttgttggttatctgtaacctgtatttttctacatgcaatagcttcgttgttataatctgtaacatctacttgagatgaatttaccaacaaaataactctacgcaatgcacaagctgctaaaggattttcatcatgcccaaacgttccagactccatgctataagctacatttcttaatttttgatattcgcctgttgcgattgcttctgcaatttctttttgagctttttctgtcgccccaaatgcagatactgaagcaacaagaagtaaagtaggaattaattttttcatggttttactcccttgagattgatgaaatattgtaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttggtttagatgaatatgccaaaatgcctgatgtaatttttgatgctgatcgggttttaaaatctattcaaaatgaaaaagtgaataaactttatttttataaggagattaatggtcgttggtatatggtcgtagtaaaaaatcttatttctagtggagaattgtttgcagagtcatttaggttatctagcttgaaacagatagaaaaagaaatgaaaaaatatgaaattattcgaataagccgttaggcagggctcgaaatcacctgcacacagtccaaggtactttttcaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtgggcgttatcgcttgcctttgagggctgtaccacaaaatctgacacgcatttgttgtgatttggctcgttatcatctgaccagtaaatcatcggtaacaatgaccgaagaagtcgaaaatcgctataaattttgcttaaaagagcttgagaatatctcaaaagggattgtgtcacttgggcttgaggaatcctccgttgaggatatggcaaatggcgacaacagcgtgcagttttttaatggcggtaatcgtatttgggggcgtgaccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgggcaccgaaggtaccagatttcaaatttgagcttttgccgcttcactcgccgttactaaggcaatcccggttggtttcttttcctccgcttattgatatgcttaagttcagcgggtactcctacctgatttgaggtcaaactttaagaacattgttcgcctagacgctctcttcttatcgataacgttccaatacgctcagtataaaaaagattagccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaagcagctgaacaaggagataaaaatgctcaactttatttaggctttatgtactatgacggagaaggtgttagacaagattatcatcaagcagctaaatggtttcaaaaagcggctgaacagggagacgtaatggctcaaaataatttaggcgtaatgtacagcgacggacaaggtgttcgtcaagattatcatcaggcggtcaaatggtatcaaaaagcggcggaacaaggggacgcatcggctcaatttaatttaggcttaaagtaccaaaatggacaaggtgttagccaagattatcatcaagcactcaaatggtttcaaaaagcggctgaacagggagatgcacaggctcaatataatttaggtgtaatgtaccacaaagggcaaggtgttcgtcaagattatcatcaagcagtcaaatggtatcaaaaagcggctgaacaagggaatgcaggggctcaatctaatttaggtgtaatgtaccttggcggacttggagttagtcaagattatcaccaagcattcaaatggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcgagtacgattatctaaaatagcactatattgccaataagggcgattatcgacattatccattagttgttgataagtttgagcagaaaaggcagcttgcatattcgtgcgataaatcgtttcaaggcgacgggggggaccaaaatattcccccgttttcgggtctgcaataacatactctttacgctgtttgtcgtaacctgtaatccaccccttacgctcaaacattgccatcacatctttcacccaagcattataaggttgcttgtttcgtttggcttctgccattgattcataaatatttacggtcatctcaaggctagataaatttgcaatgcgtgaagctctcgctcttgcagagtcacgtaacgcaggttcatctaaatgtttcgcaaatgcctttttactttctaaaaactcaatcgctttgtctggggttaaatcaagggcaaatttagctggcacggctcaccccaagcaattcagagagaaacatcgccttattcaaataatcaaaatgctgtttagaatgcaatttagggtagagttccgccagtttctcacttgcttcttcatagcttccgcaacgatgtaacattgagacaacttgtttaatcatcggatcaagttgagcattaaaatccacattttccaacgcttcatcaagcgaactatctaaaaaagcctgctcatcaaagcctgactgtgccgaaaacacgtgaacttttcccccacacccacaaggacaataatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagaaaatattcagcaatcaacaatagaaaatgctgaaattaatcctatctcagataaatttatccaagatgttgtaaaacaaggcgagagttttaatttagaagtgcaaaatagtacagttattgttccgaatgaattaaaagagaaaatgaatatggtaaagctcaataataaatttatagcatcagttgaaaatatccgtattccgcaattctttgaaacaatgaataacggactatttgaagatgttgttttgtttgaaaaagaaaacttattaacgaaatttgaattgaaacgatgtgatacacaaatttctttttcagatttagatcctgaattatatagtgttgatattgaaaatgaacaaaatgctaaatttacaccattaagcaaagaaaagtcagagcagttattacaactgtttagcaattattcattagaaagcaagaaaaaaagcattgtagaatctttgtttaatttctctggcaaaaatgctttttatcctattgctgattccgaaattaaaatttatttcagaagaattgttgaacaaatgagccttgctgatatggaaaattgtttgattaaaccagcaatctattttgataagatcaaacagaaaattaaacagctccaagaagactttgctcaagaagaattttttaaatggattgatcaagaacactttcagattaaagcagaatatcaacttccaaaagaaatttatccaaaaagttttgcagattcattaagtcataacctgtatgaaaaagaagcagaaatgaatgactctgagttcaaagctatttctctcttgattagcttggaaaatattatttggtggcatcgaattgatgaaaagcgaaaggattacagtttcaggataaacggttttatcaatcattaccctgacttcttaattttaaccaagaagaatgcactaattttacttgaaataaagggtgaacatcttgctaatcctgaatctaaaagaaaattagaattaggtaaaaaatgggaatctctagcaaatcaaattggtttacctcataaatttagatattttatgacttttttaagagaacctatggaaggagctaaatcattagatgaattgattgaaacgatttccaaactgtaattatttagcgaattccagcttgctttattttgggtttgcaactcatttattaaagtccacgtatttcttgtggcagtatggcattcaaggcaaaacgctttgagccgacctgaaaattcaggtgggcgattttttatgtctggcgtttagctttgagtgccttgtacacacaaggaatacttatggctcattacttactttcaagcaaatctaaaacattatcccttaaacacatcttccgtctaagtgaagatgaagccttccaacttttaaaagcaaaccgttggggcaatcctgataatattcacgatgtttgttgtccgcattgcggtatacgccacaatgcttattttcttcaatctcgtaaacgttggtgttgcaaacattgccaacgtcacttctatattacaactaatacggcatttgcttttcataaattaccatttgttgatattttggcagccattcttctctttgcgaatgaagtcaaagggatttcagcaataacaatgagccgtcaccttaatattagttataaaacggcttttgtcctttgccataaactgcgtgaagccttattcaaaactcgtgatttaacgccattacaaggggaaattcacgaagatggtgcgtggattaatttcaaattacgtccaattaacttcgctaaaaacgcctataaacagaaacaaaaagccgataaaaaaggacggaagtttctaaaattcagaccgactaaacgctgtatcatcagcttaaatcaacgtgcttctaatgatgaaacattatggggttcaagtcgtactattgtggcaatggactatactgaaaatgccaaaacaattttggcattaaaccatcaattcgtgaaacaaggcagtgatattatgtgtgatgaaaatccagcctataaaggtttagattttcattacactcgttggagtgttaatcacgatttatgttacagtgcaaaaggcatcaataacaatctcgccgaatcctttaacgctcgtttccgtgatttacatcgtggtgtacatcacaaatgcgataacaaatacgccctacattatgccaaccaagcggcgtttatgtcagataatcgccaaaagtctaatggtgagctgtttagtgatattctaaaacgttgtttatgggtattaccattaagggaatgggtaggttactggcaagggaatcatcgcacgctagagcttatcggtatgaccgcatttagccccgaagaaatttcccagtcctacttcaaaaatctcaatgaaagaatgaagtacgagcaagagttactggctgcctaatttgcttaactaaaaaacgaattgaaatgtaagtacagagaaatcagcttacctttgacaaggttgagcggattggctacgcccattggtgggaaaatttacatcgcaagccaataatattggcaaacaagtgggaaaatcagctaaaatttacaaaaagaaatgcccttaacaattaagggcatcaaaatttttactgcggttgagattgcattttaggttttgtgcaactgctacataataccggtactataagattttaagccatttttagtggccattttgtatactatgctattttaggagtaatagacttttcttataaaaacgacttcattggggtatagtagacaaatttgttgctaaaacatttgcacaatacgatccagttcaaccttagctgcttcaactgctttagctgcaacttcaggaccataaccaataccttctgcatacacaaacccaacatcagtaataccaataaagtttaacaccgtttgcatatacattttagctaagtccgcaggaccatctttataaataccgccgtgagcaagcactaccactgcttttttacctttgattaaaccttcaggaccattcgctgtatagcggaaagtcacacctgcacggtttaagtaatcaatataagttttaagttgtgcagggatacctaagttgtacattggtacggcaaatacaagcacatcactgttattcacttcaccaatcaatttgttagataaatcaagtgctgcacgttgagcatcattttgcggttcatcacgtgtacctgatgccgcatttaaatcataataaggaagtggatttaccccaaaatcgtgttcagtcacgttcgctgtgattttagatttaaggtaatcaactaatttgtttgaagtggaattatcggcaagaatacttgatttgatcactaatacatttttcattaaaaactccggatatcgaaaatacgattgaataactgtgttagtttatctgaatataaaaagaaataaagtagagaaaagtgaaaagagtgtttattaaaatgaaataatatatcaatttgcaaaatattaaattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttctttttctgcttttgcttttttagccatacttacctcagatttaagatttataaagggtgggaagttccccaccccacaataactactcaacaatttgagcgctcacggctacttttaatacgccttttaacggattgcttgtaccattaatcacatcggcttcaaatagctgacgagctttgtactcaagtgacggcggaacaaggatcacacttggacggatattcaagagcttgtcaccatcgccttttaacatacgcatcttcgccaacacatccatcaccacatcagcggttaagtcagacgattccactcggtgaatcagttgccagaaaccaaaaccagcattaccacgagcacgcacaccccacaaatacacatcttccataaagactttgtcggatttagacggatcaaacttcgcttcaatttcaggcttagtgcgttcttgccaaatcaacggcttaatcgcattagtatcatctaaaatataaaatgcaggtttgcctgatgctgagccagtggtgacattactttgctgtttcgccacgccagtaccgtccacattcggataaacagggtggtcagtgtcaaaaaagttctgcccgtcataacaaagggtcgatttaccttttttaagcaacccaaacaccaaatcatcaggtaactccgccgcactttgtcctgcttgttgtaccactggcgtaaataatcccacttggtcatcttcgatttcagtgcgtttaataccaaccgtcgattcaaataatttgttctcaatggtcatcccttgagcttgcatcttctggatttgacgctcacccacccattcacgcattttcgggaatgcacctaaccaaccataagtattagtcgcagttgatgatgcaatacgcattgcaagcatttcccactgcggtttaattagacttaaacctgctttaaactctgttttaaatgccgtatctaacgcatttaacaattctgattttttaaatttatccattacgcacctgcctttttatatttttcaacgtactcttcaggggttaaacctaacgcttttgcccctgccatctctgcggctgacaacgccactttctgcgtctgctcattcggatctttacctcccgactgcgtaccagcaagggcagggttaggcgacaccgttgccaaataatctgataacgccaccagattttctttacctaatttttccgcccacgctttctgtgcaggcaacaaacgtccatcagataatgcagattgaattaacgcatcacgttctttatcgttcatttgctgtttaatctggttaagctcagtttgcaccgcttgcaaatcgcttaacgccacaaattttgcaggatcgggattgtttaccttcgccgttaaagccaccacctgctcctgttctttggcaagctctgcatatacatcgcttaatgccacttggctgtcgcctttcgctgccgacaatgccgtcagcttagttgtaatttcatcgtccgttgcttgagctgacaagccaaacaacttaatcaaaagttctttcattttggttttatcctcgttaggttctaaaaagtgagaaaactgagcagacattgcgaccgcttccgccaaattgtgtaatgcagggcggttggttaaagcagcatttaacaccttaatcaccgtacccgacgcatcagccaagaacagcggtgaaatatagcgataaaccccatctttaatttcagcgaccgccttagatgtccaacgcacatcagcaaacaagccttcgcctgaaatatattccgctctcacaatccagcctgccgcaggattgcctttgccgttttctgcaataaagagagtttgatgctcataatcaatcatcagctcaatgcctaactgattgatctcatctgctaattgatagccgttagaatctcctacataaaacgccccctcacgtccatcttgcggatgaaaccaaccaaacggaaaaagctgaatacgcccattgacctctttggcaagttcaaaactgcaagctatcggattaagtttgaatttacgcttcacaacgcacctcatacaaaacattgaggctagagaataagagataagagaaaaggaaaaatgaggaacaacttccacactaaagggaatttgcaaatttttgaaaaaaagtgaccgcttgtatagcgaaagagatacaacccattttaaaacgttttaaaaccgttttaaattgttttaaaaaatttcggacgataaatcataccaataaaaacaaaatcgccactatgggcgatttagaggcgttttagacatcattttaaaatcgactgccaatagtcctgaacatcttgcaaaatatcttcctcgtcctgtggtgtcagcattaaaaaaggacgggcaggaatttcgactttatcagtcatcacccagcgatcaccaattttaaagacaaggtatttaccttttttaggggtaattacgccgccgaactgatgaatagcggcataggcttcatttgttcccacaatcgctttatcattatcagagacctgttggatactcccttttaaattacccgaatcgtttaaaggtatgccactacggtggtgtattcccgcccaagatggacgaccaccagcttcaaaattatcaagcactgctttccgcattgtgcctgcaatatcacgcattaatggctcacgatggcgagtaacttttgccatctcgcttaatatggcaagaattttatcggagttgttgatttttaattcaagcattgttatagtccttacattaaaagccgttagaaaagcgatgaatctcgacgatcgcaagcgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgagtctaatgggacgttaattgtaggtggtgcagattattctaccccaccagtagcaaccctctatgttagagccaatgatagcagtcgcaataattttaatgaggcaagtttgacctttgatgtgtcgcaaagctattcggaagtgacgtttttaggacagaagcacggccgtgatagcgatagtgcaaaacacgattttaagtgggtttataaaaatcctgagttgcagatttataaacctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtggaggtaattaatgagtgtggtcattaaccaagtggcaaatgccaatgtctatatcaacggcaatagctttttaggtcgagcaaaatccattaaaacaccggagtttgaagtggagtttgctgagcacgataaccttggcttaattggcaaattgaaactgccgaataaagtcaatgcgttggaaggggaaattgtttgggacggcttttatctggaagtggttgctttggcttacaatccatttaaagcacaccagttaatggtgcgtgccaatgtacaagcgtttaactcaataggtatggcaaccgaagtgccgcttgtgatgacaatgacggtggcattcagtaaagtgaacgtgggcgaatataaaaaagagccgaccgaatatgcgatgacttaccaaatcaataacatcaagcaagtgattgatggcaaagaagtgctgtactacgatgcctatagcaacaaatataatgttgcagggcaagatattttacagaaataccgcactaacatcgggcagtaaatctttaaagtagtttaaaatcaacccgtagccaaaaaccgtaaactccttagtgaagttaaacaataccactaaggagtttttatgcccaaatcaaatgaagcagtgactacacttaaaaatttgcgtgtttataccactcacaaattgaaatatccaatcactaagccggatggtgaagtactgaatgaaatcaacctacgccgtatcaaaggctcagatttagaagcttttgaaaataagaatttcaatccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacatttgaccttgatgtttgtgcaagctcgcacaatgcaaaatgcaagaggtacattaccgccgagcaggaaaagtatccgtatgcaacacacgataatcaccgccttctactctcggcggtgcattaaaaaatccaactctttaaaatcgtaccctgttttaacgtccttttgtaacagcaacatataacggctctcaatattaccgctcacacgttcaaacaaaggtgcttcgtcccatttttcccgttttttccagctggcgatagtggacacgggaatgttaagcattttggcaatttccgtgagtgaatagccagcccaatactttaattgtgcttcacggtgggtattcatattaattaaagcggtctgttccgcttggtttgttgcaatatccgtcattgttttgcgtcatcgttgaaaatatggctattgttatgaaacggacggcgtttgtagaacagtcccctttgttaaatcctgcttaacaaccgcaacgctttgcacctgtttgaaaatccaatcaccatatcggcaattttgaacattctcatttcgaggaagcatttatgccgaaaaaatccaactggtttgtggtagccacagaaggagcaacggtggacggtcgtcagatcgaacgccagtggctttctgatattgccgaaacgtacgacccgaaaacctacggcgctcgtatcaaccttgaacattttcacttgttttggttcgaccctgaacttgcccattcaaaatgctacggtgatgtgttagccgttaaggcagaagagaatgacgaaggcaaattacagctttatgcacaaattgagccaacggatgaattagtcgagttagtgaagagtaagcagaaggtttacacctcaatcgaagtccgcaccaattttgccaaaacaggcaaagcctatttgacaggtttagcggtgactgacacgccagcaagcttaggcacccaatatctctctttcacaacgaaaaatggtgaacagcaaggcgaaatctttaccactgaagcggtggaatgttcgcttacctttgcagaagagccagtgtcattctttgaaaaaatgaaagcgatgtttagtaaagaaaaagctgacacagcccaacataaagccgatgttgaagcacgttttgctgaacacgaacaggcacagttgcttttagcagaaaaatttacagagctagaagataagctaaaacaaaccgaagcggaaaaaatggcattgtgtgcagattttgaaaaattatccgccgatctcaccgctttacaaagccgtgttgatgttatcggaagtgagccagaacacggctacacgccacgccctgaaattacgggtggtgaattaaataatgaacgtgttttctaaaaaggacagaatatgagaaaagaaacagcgaccaaatttaacacttaccttgcaggtgtagcacaagacaacggtgtggattacaaccacatttttacgggtaaaaatttcgtttcttctaacgatgatttcgttgtcgaaaattatgcacaagtcgccctgttgaaaaacattagtatgcttggctcacctgatactactggagtaggcggttaatgcgaccaactcaagcccactatttgcgagtaactgcggagcttgctcaatcttctgagcaagcccaactagaaaacctcgacgaatacgaaaaaatgctttatttgctggctcgtcataaaaaagacctgaaagccattgcctcaatggaacagcgagccagttataaaaaaagcattctgcaccactatttgccgtggattgaaggggcattgagtgcgggcaacggcaaacaggacaatgtactgatgacgtggcaagtatggtcggtggattgtggcgagtatcaccttgctttacaaattgccgattacgccattcatcaagacctaacattgcctgacggctttagtcgttcgctttgctcaatgcttgctgaagagtttgctgacgctgcgaaaaaagcccagaaggtgcaaaagccgtttgaagtgagctacttgttacgagtggacgaactcaccaaagagaaagatatgccagacgaaagtcgagcaaggctctaccgtgaaatcggcttgctacttgaaacgacacagcctgaaacggcactcagctacttagaacgggcattagaactgaatttaaacatcggtgtgcaaggcagtgttaaaaaacttcagaagcagttaaaccaagccgacaccgactaaaccgagcaaaccacgcagccgacggggcgtaataatggggattttattcggcttgtttaccctattgatgaattggtactacaaagaccgagaaatcaaactgaaagaaaaagcccttgagtgttacaaaatcaacttaaaggacattttagacgatgaacaaaaatcttaaattcggcggagcgatggtctgcggtatcggtgcgattatcggcttagtacagcttaatcaccctgaaatccgcaccagtccaaaaggcttagacattatcggcaacactgaagggtgcagacgagatccttatgtttgccctgcgaatgtactcaccgtcggcattggttcaaccgaagccacaagcggtaagattgaacgcaaaatttacagcgacaaagaaattgctgaccgctgggcaaaagatttagccgaggcggaacggtgcgtaaaccgctacgccaacggcaaaaaaatgccacaaggagcgtttgacgcattgacatcaattaccttcaatgcaggttgcggaacaatgcgacattcgaccttgttcaaactcgccaatcaaggttacagccctgcaatgtgtgaacagtttagccgttgggtctatgccaatggcaaaaaactgcgtggtttagaaatcagacgagaaaaggaacaagcactatgtttagcattataagcggtatgattgagaaaagttttggcaaagcgatgattatcgccttgctggttgctgtctgcattaatgcctttctctgttacgaatgcaaaatactgcaggcggataacaaagccaaacaagcagaaattgccttggtgcgagcggataaccaaagcctagccaaccagctagaacaggcaaaccaacatattctgcagtatcaaaagcaggtggataaattacatcaacaagttttaactaagctcacccaagcggagaaacgcaccaatgaaattttacttgaactggaaaacaatcaatcttggagctatcagcctgtgcctactggcgttagtcggttgctcaaccaaagaagcggtacagtatcgaacagtaaagccaattccgctcctttgcccccaaataaagcagtgccacagccccaggttcgagataaagaccaacgctgatcttgcaaaatcgctcgaccaaagtttgacgacgattgagctttgccaggtggaaattcaaggctgggaagcgtgtgtggaaggttataataaacgtattacagaataatgattgccccgactagtcggggctttttattgacagatgaaaataaaaagccgacaatgcaaaatatattgtacgttttctatgtaatggaggggcaatatgaataaaaatgcaccttatattcgtgaaattgttgatcgcacaaaacaagtcggtggcacacgaattgtcggtaaaaccaaagaagaaattcaaaaaaatgctctgttggtactacaacagcaattaaaacaatcaaatcaaaatgttagaacgcaaagtcccgaccaatcaaggcttttggtcgtaaattgacaattttcttattcaacgttaggatccaactattccctttacaaagcggagaaaaacaatgattattttacaagctcaacctatggcgcaagtgccgcataatgcagtatttgcagtggttgaaacacaccaaaagccattgcgtgaagtgccagcactcagcccacaagaatataaagtgtttgcgaatgttgaacgttatgcacagcaaatgacagaagaaagtctaatgcgagcaatggtgctgattaaatgaatgttgcatatacgcaactcttcaatatggcattttccgatgaagaagataaacaattctttattgaacagtttaaatattggaaacaaaatggcgaaaatagtagctatcattttggcaaagatgggttttatacccctattcaatcaggattaagacacgttcatcttgttcccgttattaatatccttgataaaataaattgggataaacattggcaaacagggcaacgccgaacgagtgatacttgtcttgtgtatgttgaagatggctcagattatttacttattaccattttacctgaaccattagcccataaaattgcagctcaacgagaagaaaatcatcgtgtaataatgaaacatttccgacacattgcagaacaatttttctattatcgaaatattgtcagttaaataaagcgacactagtcgcttttttgttacccccaaatccacacccacaaccattcgccccacctttgctacttactcacaatatcgctatttaactcaacgagaaaaagcgatgaaagaccaaattgaccgagccaatgagcttgccgaaaaagaaagagagtttgcccttgcaaaacttcgcaacaaaccgaccgcttgtagcctgacccattgcgaagattgcgacgaaccaattcccgaagcccgtcgccaaaacgtgcaaggttgcacccgttgcattgattgccaacaaatttatgaatacaaacaaaaaggctatcgcaaatgattaaaccagacaaattgcgtgacctgctcaccaaaaccattccttattttgcgaaaaaacctgagcaattacagatttactatgccaacggcaaaatctgggcgacaggggcgacatcacttagctaccaatatctctacgacttagaaattgtggtggaagatttccctgaacaccctgatttactgtttgtgcctgtgatggaatttatccgcttgcaacaatcggagctgatgaccaatcccaacaaacaggacagtatcacctttgaaattgacccaaacaacaacgccacccacgatatttacatcaaaatcccactgaccgagcgtgttattgtcaaacaagaaggcgatcattaccaagttcaccacgccgaagagccacagccgaccgaatggcaacctctggaacggctgactattttgtgaaaggggaacaggtgtatgagcgaatgggagcgatggaataatggcgacagacgacattatcaaagttaaatcagcgtttaatgcgttgctcaaaaatatcagcaaaccacggcgacggttgctatatcaacaaatcgggcgtgaattggctcgtagccaacgcagacgtattaccgcacagcaaaatcctgacggctcgtcgtacacgccacgcaaagtacaacgtaagaaacgcaagggaaagattaaacaaaatgcaatgttcttaaaattgaagtcagcccgatttatgaagttaagaaccgctggggataatatcgagttgggttacagtggcagtgacgcacatattgcacaaattcaccagtacgggttaaaaggtcgagtggtgagaagtgcaaattggaaggtgaaatacgatcagcgtgagttgttaggctttaccgatgaagatattgaaatgattgaaaattttgtgattaaggcgttggcaggacagtaaaaaaggcggttagaccgccttagagtgatatttttcaatgagtttttcattatctttatatttaatgccttttttagcgagatcatcttttacaacttcatcatcggctgcaaaccacgccacaataaagaaaatgataaatccaactaatacaacaacaaagccagtagttggtagtaaaaagtagagagataccaaaataagagcaagagataatccaataaaatttgagaaaaaactcagtatggcaaccaaaatcgttcctagagttgtcatcgctcctaaagcgattgaaattcccaaacctaagaaagcaccaaaacaaattaatgctattggaataagtaatagttccataaacgcccccttgtttttgtgaattattgagcgaaaacggatctattgtcaataaaaagagaaaaaatgatgagcaatttgaaattagaagtgttgttaagtgcgatcgataaactttctgccccttttaaaaatgcaagtaagcaggcggaaaagctatcagccaccttaaaagcaagtaaagatgccgtgcgtgagttggaaaaggtgcaaggcaaaatcggcacatttaaaacaatgcaaaccaatcttcaaaaagcgagtgaaaccattcagaaaactacaaataaagttggtgatctgacaggtaaacttgagaagatgaaaaagcagaaggttgatttaaaaatccaaattcaggcagaaaagagaaattatcaaaaattaatttcaggggaggactttctgaaaaaacattgcaagtggatcgtaatatcgcaaaaatgcaacgggaatatgaaaaattaactcagaatatttctgttacaagtaaaacgctcactaaagaaagtaatatattaaaacaatctcgcactgaaaaagccaaacaacttttaattttccggaaattaaaacaggaattaaaaacaagcggtattcatattaaagatttatctaatagtgaattatcgctagcggaaaaaataaataaagctaatcaagctattgataaacaacggcaagcattagaacgtttaaataaagtcaaacagcgaaatgaaaattatcggcaaaatgtcgataaattaagaaataccagtgaaagcctacaaaatttaggacagcgatcaatggtaagtggtgcgatcttgcttgcccctgtggttggtatgggaaaaagtgttgtaggaatgacacaaacggcaggtaaatttgagcagtttaaaaccatactcgaaacggttgaaggctcaagtgaaaaagctaatcaaagttttgaatgggtaaaacagtttgccgtagatacgccagcgaatttagatgacgcaatggaagcctttgtacgattaaaagcctacggtttagatccaactaacggcttaatgcacaccttatcagatacctccgctgcgatgggtaagccagtaatgcaagcggtggaagccattgctgacgcagtaacgggtgaaaatgaacgtttaaaagaatttggtattaaaggtgccgttgtaaaagggacaaattttattgaatatacctatacagataaggacggaaaacaacaagttgctaaggttgataaaaacaaccgcaaacaaattgaaagtacgttacaagcaatttggaataataaatacaaaggtgctgctgaaaagcaatcaaaaacattattaggcatttggtcaaagttaggcgatgtatggacaaactttcaaatgcaagtaatggaaacaggtgcatttgattggattaaagacaaaattcaaggggttttagataccctagacaaaatgcaacaaaacggcgaattaaaaaaatgggcagaggcattcggttctgtcattatggagatctcacaagggctttgggcatttggtgagaaaatctttgccgcagtgaaatgggtggctgaatttgcacgagaaaataaaggtgctattgcaacctttgtgcaatggtcggcaattttaggttcaggtctgacgattttcggcggtttggcaatggtattaagttttgccttatatcctgttgctcgtttaatttatggtttcgggcatttaagtggcatcacaaccttatttaataaagtattatttgataatcataaaaaatgtagattagcaaataaagctctatatcaatattcaaccaccacgagttatgcaaaaagtaaatttataacttttaaaaatactgtatctaaagttccgaataaaattcaaaatttgccgacattactacaaattggatttataaagttagaaagtaagttaagacaatttttccctttgcttaaaactaaagtcttttggataaatttagcgaaaggtgcaatatttaaactttgggcagttattaagtttctattttcaccattgaaattattgctcggcattttttcaccaattggattagcgattacagcaatatctcttgctggtatcgccttgtataataattgggaaaaagtcaaagcctttttcggtggattttgggagggattaaaacaagggcttgcaccagtgcttgaaaaattcacaccacttggagatttatttggtgtcgtttgtggttggattgaaaaggcggtgaagtggattggtgactttttcgcaccggcaaacgaaagtgcggaaagcctcaataaagcggcagaagcaggtaaaagttttggtgaaatcgtggctaaagggattgaattagcacttacgccattaatgttaatgatagatgcgtttaaatggattgttgataatgttcaaaaaattgcatcaagtattgttactcctgaacacgccaaacaaattgaaaatactgccaatatggcaaatatgatgtacgacccgaattatgatccaagctctaacaatgtgccaaataaaccaaaatggtcaggtggttatgctggtaacggtggtaagtttgaaccaaaagggatttatcacggcggcgagtacattatgaccaaagaagccacaagccgaattggtgtggcgaatctcaaccgcttaaattacggcggtattgcaggtatggctgctttagcttctacggtagcactggcacaacctatgcctgtggtaaaagtggataaccgtccgctgattgccccaacgcaaatccaacggcaagccccaccgcctgttaatcagtcggtcaatatcaccgtcaatgcaaccgcagggcagagtgctgaagagattgctcgccttgtcgcacgagagcttgaaaagcaacaacgcaacgcccaagcgaaagcacgcagtcgatattgggataagtgacccagtacccagtttgtgacccagttgaaaagccccgaacaatcggggtttttacttgcagaatacagcaagttaaactatgatccgcctgaaataacgaggtggctatgaaaaaatcatttacagaaaaggcaaaatcattgaagggcgtaagtcttgcaatgggcatttttacatctttttttagtcaagacacgcaagcgacacaacaaaatgatgtgcaaaatctaatgcaacaggtcaaacaaacatctcaaattcttgttcaccaaaatgttgatgaaaggtatttcttttccgtgttgtctcaattgaatgaaactatcgctctattaaatgatgtggttcgttcaatgtcaaaacctgaaaaagttatcaatgatcttatttttattgatacaggattaaattcattagctcaaatggttcgtcagaaatatattgaatttttaagaaataatatttcggaacgcactatctttaaacattttacggctgaagtttttaaattcagtgtatttactgaaaaaatgcgtgaaaaaacaaatcattattccattgtgccaagtaaatcaaattttactcaggctgatttagatgaattggtgacaaaatacaatggttgagatttatcttagtccatttgttattatgaccgatggtttagccaaattaattaatgatttaatgttattagaacagtcaatggggcattttcgtcccgatactattggaaactggggagcatttgaagaaaatccgcgcgcgatgttagcattagtaaaaaaggtacacgtagccgtatctaatgaagattttgaacgatggaaaaagaaaacaggtcaaaatcgtaaaagtgataattatctcatttatactaaacacgaattagaagagaatacttttcttatcttagattttattactcctgatgctcatcaaaaaataaaatcaaagctatctgatattgttttatttgcggaaatttttcaaaattgtcactcagcaaaaatagccgaacattttagacggtttgaagagataaaataaatctcgatttcttaaataaatattgtttaaacccaagcgacttcggtcgctttttgttacccccaaatccacacccacaaccattcgccctttgtacttacctttcgcacaatatccccatttttaactgacggatttttattgtgcatcacgatctatcccttgtgtatcaagcacgcaccgatattgtgaatgtgtgcaaatgtgtgcagttgatgtgtgcagttgatgtgtgcaaatgtgtgcaattaattttagaacagatcaaaatcgatcaggaaatgactgttttttataaaaaacagggggtagaaaacgtggtttttagtgtgtaattagttatcaaatactatgtaagtatttgtttttatgggaattttataaaataaaagcagaaatgggaaatttctgctttagggaaaatggtgcaacagtccaacttcgtcttaacgcccctgtatcaacaggcgatttcgcttgcactttcgcaaaagcctctaacgccactttacgaatgactaagtttttccgttgctcaatctgctcaatttgttgctgaatttgtgcaataaaactactcattgttttctcccttggcattgataaagcattgctacactagcaggttttatcggctgaacggcaataatgctccacacctcgccattcacttcaaccgctgagccgacttctgctttttctgtcagataaatcaccacgtcgccttgctgtaccgttgcaaattctcggtttactgaaaaatcataagccagattatcaaaaagacagtaagcattctgtttcctgatctcagtttgcatttttcccgtggctggatcgtattgcccagatatttgtgttttaatcaaacaaggcgaaccaaacttctgaattaactgcttggagatttgctttaatttgccgtacaagttacccccttaacaaggacacattgttagtagatgatgaatttaaaaagcgagaaagcaaggttttgacatactcaaaccgattgctactaccactgatagtcgcttgattttcgtaattgacagaaacaggccccactttcacgcttgccatcttctgttctgggttctgatttagatcagactgcaatgctaattcgcaaaccgcatatttcacttgtaacggaatttcgctactctcttgactactttcttgacgtggaaattgtctgatttgtgttgggtctactttctctcccacaaaacgataattgtgatcgagaaaatctgatgcactaactaagcgacgagctttttgttcatcatcaagttcattccacgcttcaaaactggccctcaattgatggtagccatttgcctcttcaagggaaacataactatccgttggtacgttcagggtcattgtcgccccctttcgcttgctttaataatgcaatcagctcatcttttttcgctccttgtggaatttccacattcaaggctttaagtgcggtggttaattctggcacggtcatcttgtctaatggttttttatcagattgttcatcaacccattgaaccttaacccctaaggattgatacgcttgtgcaatcttaggaaaatccccataaatcaccacatcggtcaccttactttctgctttttcaaaatacagcggatttcggtaatgtttatgcggttcaaatcctgtggtttgcgttgtataaattaattgcattgattactccttctcaacataaaaagcggtacgattttgttaattttttgcaaaaacgcaccgcttttatattcacttaacttagttagcttaattcaattaacacgccagccgtatttttattgctggtcgcatatttttgccaacttgcttccgtgccaatggtcgaaaggttagggttcgctcccgcactttctttgtacgaataacctaaaacatcaaggttaaatgtgccttccgcacgaataccaatcgctaagttttcttcactgttaatgtcataagctcggaaacccggtaattgcgaattcgtgatagtaattgctccggcttgtaagcctaaaatggtgttagctttggctttatccgttactaacacaggcttgcccattgttgccggtaaaccgccataaataatctggtcttccgattcaaatactttatttgtaattgcatcatcaatcagatcaaaatagacagcagagtccatcacccataaaccaattcgcccaaatttatccccaaacttacgcatccctttggtcaatacttttttgtgatcggttgcaatagacgccgaggctttcatatcaccattcgtcccaattgccgcgattgcaccagcagtcaggtatttaaaataaccgtctaataatgcatccgcatagtcttggccaataaggatagaaaactcctccgtgcttctcgctcggcgtttcattgcctcttccgtaattgcataagggccgtatttaaacggaattttcacgccaaccatttcacccatcgcaatggttttattctcaaccgcgccattactatttacatcacgatgttccaaagaaccaccgattttgtaaaaagattgtttgcgaaaatcgccttggatattctcatcttgcaataaaatgcagccgtttgaagcagcattaaatacattaagattatcttgaatacgctctaaatatgcagtttgagccagttcattgtagataatcacatctttgtttaagcctgttgccataatgttttcctttattctttaggtagattaagatatgcctcacgaccgtgttcctgaataaacttgttcatctcttcaggggtcatttggctacgtttaaattgtttgccagcgggagagccagcaccaccgccaccaccgcttgagccagagccttttagaatagaatctttgttagggtaagcatccactaaagcctctaacgcctcttcaaaatccgcacgttgccctggtttcactcgactgaaaatttcgttgccaagcgcatcttttgccaaaattgcaccgttttcatcaatgctaaaatgcttaccaaagaacgcttgagccacatcaacaggcattgccaatttctctgtgacaaacttagagcgagcgaatgagccgccaattaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacttcaagaaaatgcttgcagcattcgaacaaactgccgcattacgccgtaccgtaacgattgaagatgtgggtaattcagcagcattcttatgttctgaccttgcttcaggcgtaacaggtgaagtgttgcacgttgatgctggttttagcatcacagcaatgggcgaattaggcgaagagtaattgctttttgaattgatgtataagggcaggttttattcctgccctttgtctactatgcctttttaaatactaatacttttccatttatcaaaacccaatccgtcttgccactttcccttgtttaatctcacactctgccttaatcgcctttaaccactcatcaacattctcaaagggtgcaaaacgatgtcggcgagcgactgcggcaaaatcaccaggggtcagatttcttaattgagcaatgcgatcttgttcaacatcagttaaatcaggcaagctcaatttattgacttgttcttgagcaaatttaaccgcttgctctggcttgagataatcaaaatgcaatttgagatcaaaacggcgtaaagcagcaggatcaagcccgtccattaaattcgttgagaccaccaatagcccttcaaatttctcaatttgggtcagtatttcattgacttggctatgttcccaactacgttgcccactttcacgggcaaacaagaaagtatctacttcatcaaagaccaacaccatattattttctttggcttgtgcaaaggcttgagcaattttttctctgttccacctacatatttatccaacaaatctgaaccttggcaaatcaatactgacattcccaactcttgccctaaccaattcgcccaagctgttttgcccgttcctggtggaccataacaacaaattctaccccgtttagtccgctttaacccttcagtaattttataaatatcatcattgcaagcgacccaatctaagttgtagctaattttcccttccacaagcggttcgattttcttaaaaccttgcgatttcaacatttgattaaaccaatttaacgttttttcggcaaaatcctgttgagaacaatcagaatacgcctgtttcatcaccgtcaatccacgcgtaattatcgcaggcgacaaggcttttacttgtgaaaaatggcgaatgtaatcgtgagataactgttcattgacaatagaacgaattaacttttctttatgactaaatggcaaatcaggcatttcgaacacaagatcaaaacggcgtaaataagcgttatcaatacaactgaccgaatttgacagccagatcatcggtacatcattattttccaaaaactgattaacccacgccttgttctcctgtgccacagagcgttccataaaactgctggcaaacacatcttcgatttcatcaaaaataatgaccgtacttttatctcgcaataaacgttgagctaaacggcaattttctaaccgtctttttccaccaagtacatcatcatcttcatccatatatgccatcgtataacttgatacattcaatgcttcgctcaataaccctgcaagctcggttttccctgttcctggcgaaccataattaaaatgttcgtcccttttttagcgttatcaatgctaaatttcaaatgagaaagcattaattcataggttgtttttatatgctcaaaatgggaaagagaaaggctcggcttttcagttggtaaagtgcaacgagctaataacatctcttccgttaaaggttgagttaaaaagtcgtcaaagtctaatgtatctccccaccccaaatactcttctaatcgatcagggctatgagaaaactccattaatccataagcaaataatttctgttttttgctgaaaacctttcttacatcatctttactcaacgataaaatatccgcaacaatttcaatagcttggcttaaattgatatgcggaagatagcacatcaaatctttcatctgtttttctgctctcaagtggaaaacaaaacgaaaaatgttcttttctgcttcatttagctctacaatctcacttaatttttcaatattttgatatgccattttccaacgttcagacacatcttcggaaaaatttgtttctttataacgagcctgtaaaagctccttgacaagcaatcttagattgtcgatattttccatttctggcggtaagcctaatgcagttgcaatatcatcatctcgccagccattctctctaaaaatttcaggaaagcctttatgctcaaataagagtttcaacattaaatgctctgcataaactgaaaccgtaggtgggtttaattgatattgattgctcataaaactatctcctatcctatttcacaatagtattttattgagtatagcgacaagatgtatcgcactgttttatggtataaatcaaagtcggaccggtaagatatgaatatggaaatgaaacgtaagaattcaaaaggaactaagaagtttttgtgaaaatttacaaaaacgacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaggtaatgaaggaaatcaagagcctccaacgcctcctgcgactgatgatgacgaaatgggcggtaatccagatgatgaaccaccagcacaagacgatgatgaggataagttagacaagctcttatccttagttgaaagtcttgtttctcgtgtggaagcgttagagggtaattcgaaatcagaagatgaagatgataaccaagaagagccacaagagaagcctaaagttggtgatgaagaagagaaaggtgctcaggcaatggatatggcggaagtgacacgacaagttacaaaacgcttaaacgagcgtgattcgatgtacaaaaaagtttctctacatacaggagcttttgatgtatctgcaatggattctgctgaggcagttgcagcgtatgcgtgtaagaagttaaaccttaaaacagcaaaaggtttagaggttgcaacaattacaggttatatggcaaatcgtgagcctgcaaacaaacagcgtattgtttcaggtatggataaatcagacgtagttaagggtaaaaacttcttaactggtcaaatcaataaataaggtggtaattaatggcttttcaacaaaacgtaaacattgaaatgggttttggtgtacctggcgacattcacacagacggcccaacacgaacagaatccttggtggttaattctgaaggtgctcaattaaatcttgtgggtagagcgttcacaaaagatgctagcaaaaatgtagctaaagttggtggtgcgattgaaagtggtcgagtttttgcaggtatcttagtgaactcaaaggcttatgctttaacaggattatctggcaatccattagcaccaacgctagcggtggcagataacactcaagccgatttcttaacgatgggcgatgtcgttgttcaggtttctacgccttgcaaaattggtgatttagttgcttacgataccactacaggcgaattatcaacagttgctgttggtggttctgcttctggtggtaaagcattaattcctaatgcgacggtttatcgcttccctgtaacctctggaagtggcggtttaaccgttattcgtcttacaaactaacaaataaaaggacagaataaatgacaaaaaaatcaactcaacacggttttatttctggccgtgcttatgctaaagcattacaagagcaacgttctgcaatcactatggatgcggcagatgttgcacaatatgcagcattaaaaaacattggtattggcttttctgatgcatttttaagccaagcaaatgttgcttatggtatggacgatgttcagggtggggtaactgctggctcgacaggctctcctatccagttcttgcaagcatggttaccaagttttgtgcatgtagcaaccgcacctcgtcagatcgatatcttgactggtatttctacagtaggcgaatggcacgatgaagaagtggtgcaaccgattttagaaatgaccggtaaggcagttccttatggtgatacaacaccagtgccattagtagggtacaaccttaactatgaacgccgtacaattcaacgttttgaggcaggttttgcagtaggttctttagaatctgctcgtggtgctgctgctcgtttagatgcggcaaataccaaacgtgcttctgcaatgttggcgttaaatatcattcgtaatgatgtcggtttctatggttacaatgatggcaactctcgtacttatggtttcttaaacgatccgtctttaccagcatacaaaacagtagctcaaggtaaatcaggttctacgaaatggaatcagaagacctttgaagaaatcacaggcgatcttacaaccgcatttactcaattagttgcccaatcaaaaggattaattgatgcaatcaacacgccaacaacattggctcttcctgcgggtcatgaagtcattttaaataccgtcaatgcgttcggtatgagcgtgaaaaaatggctcaaggataattaccctaactgccgaactgaaaccgcacctcaattaactggtgcaaatggcggcgtagattcattctacttatacgctgaagaaatcgtaggtgatacatcagatgatgatcgtcgtgtttggattcaagctgttccagctcaatttatggcattaggtgtcgatccgcaagggaagcgtaccgtagaggacaacacaaatgcaacagctggcgtaatgtgtaaacgtccttacgcagtatatcgtgcatcaggtatttaaccttaaccactcaagcccagttaattctgggctttaatttttaaaaacgagaggaaacaacaaatgaattacgtttacagcactttgacttgtgataacgcatatacggtctatgaaaaaacaacagggggcttaactatccctaaaaccgaagtgattattcacggcggaacaggattggcaaataaacatctgattacaccgcttggtacggttacaaaagtaagtgatgatgaacttgcgatgttaaaaacaaacccagtatttattgaacacgttaaaaatggctttctaatcgtccaagaaggcggtaaagctgacgatgcggaaaaagtagcaagtgatatggcggtagatactggtagcgcaccactaacagagcaagatgccgaaaatacgggtgtaaaaaaagcgaaaaaaggtaaataaagatggatattgctacgttcagaaaaatgtttcctgcttattctgatagtcaaacttttagcaatgagatgatcgaaatgtggctggacgtagcaaatgttcatctcaaaaaaggctggtcgttaagtggtaaaacctacgaacatgccattatgttgatgttggctcatcttcttcatagtgttgcgaaaacttcaagcggtaatgctgaatcaggacctgctggaattgtgacatctgcgacagaggggagtgttagtgtttcttttgcaacacctacgacaaaagatgcgtgggaattctggcttgcatcatcgccttatggattgcaactttgggcattattgcaacagttaggaactggcggtttgtttattggtggtttaccagagcgaagtgcagttcgtaaggttggcggggtgttcttatgagtcgggcggataagtttagaaaggctttgcaagataagatcgacaaattgagtgcagccaacaacaaagtcgcaaaagtcggtattgttgaacatcaacattatgatgataacacgccagtagcttatattgcttcaattcatgaatatggttctcctagcaataacatcccgccacgtccttttatgcgcccaacggtatcagagaaaaaaggtgagtgggcgaagataggtaagcaaattctgcaaaatggtggtgatgtcgatagtatgcttgaaatggttggtttaagggcttcggctgatattgttgaaaaaataagtaatattgatgttcctccactggcaatttctaccaaaaaagcccgtaatcgtaaggctcaccaacaaactgccaaatataacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtcattgcttttaggtcgtccgctgttcctttatagggcttttggtctgggctgtaagctaaggttttgccaactaatacagctctacctttttcactctcaaatgcttttaagtcaagaatagctgtattgcttttgccatttaataccgttgctatttctccaagtatagacttaccagccccgccttcacctgttgcttcaaggaataagtgccattcgtggcgatttgtcaaaatcatatacagccccgccaagattgcatcgtgtttttgttgattgccattactgacaaaagataaccagtcatcaaaataaggcgtatcggtgcaatccgtccgacattcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatatgattgatggagtattgtcaggcacatttttcaaaagagtgaacctttttgcaaaaaaaattataaaaaaaagaccgcttgctaggcggtctttgaaagttaaggttttaaactgcaaactgggataggaaatggtcgagattttgctctaatggttttccctgtccttgggtcagttcttgtccaacgaaaaatcacgccacaagaatacccgcaattgcagtttttattgtttttattcataagaaattccttcttaatgaagaaatcccttgaaaagtcacgaaaaacaggtagaatttgtaccatatttcgcagaagtcaatagctaacttctgtttttttatacaaaaatccctaattccttgaaattatcaagggatttcgtggtaaaggtcgttatacatttgtcgtcaaacttaatgtgtataacaaccacttaattaagccctaaagattcgcagtctttggggctttcctttatctgtggttttatccaacagatagaatcattctacgatcaaatttcaaacaaatcaagaaattgatcgtcaaaacctatcataaaacgcccagaatagcccacaattgcatttttatcaaaatttaatgtttagattaagctaaaggaataactcgcttaaaatcgcttaaatttgcaaattattttgcataactattttttgaacaacgttctttttttgtcttttttcgtcttttgcaccataaatagcataattattcaaatttaaagcataaaaaaagagccacagcgtggctcaattatgcgtaaccccgtacgcttgcgtgcgggggataaaaagatcggcagttaagcaaccttcaaatttagaatggaagtaatcttacttggtatttaccattttgttcatctattacatatttaatagcggttggaaatggaaatttatcgggaatagagtgcatctctacttgagcttgacaaaatctcatattcttttcttgctgatagccaatttcagaaatataagtcaaacctaatatatcaaattttcctgcatagatttccgcattcattttagtaaccatttcaactgtctgtttactatcacacttaggaagtccaaaaaaatctttaccccattgagaccacgccatataacccaaaaacgtaagccaaataagtaatttaccaaatgcagtccaattaaaagttgaaacctgaacactatcctccttcgtttcactttcaggctgaggaacagtatcaacaacaatagattgctcaatttctgtaggcttaacagcttcttctgtagcattattttgttgttttctttgttcattttcttcaatcatcttagacacattttcttgatgattttgaattttcttaaaaatagacgagaacattgtaaatactcctatcttaaaaactatctggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaagcccatattcattcccgccaccttgaccaactcttttacgagtttcccaaagttgttttttagcttggtaaataattccttgcaccgaattcggtaaacaggttaaacttaaaagtaataattctttggctgagtagtgcgtttttaagttgttttcactcataaaagctccttagagcgttctctcagcgaattttttaaggctacgctgagcaaatcgccccgcccaaatttcctcaggcggtacaccgattgcatctgcaatgatttgttcgccttttcgccacggtctatcaagggcattctttaatgtgctggcttggctataaccgtgttgtaatgaaagctggcgtaacgaccaaccagccttatgtaacgcagcaataatgtcggctctatgccagtcttgtgctgttttttttggctctgtcaatgtactcattagataactccatttgtttaacacgagagataataaacctcaaaagaaactaaatcaagtttaaaaagttctttttaaagttaattgattgcattttaatcgtttcttttgaggcttttaatctaaattattgttttaattgttctttttagaactttaaaaacattaaaaaagaaattaggattttttaaagttatgactgaaaagtttaaaaacaaatcaatgattggaaaccgaattagagagcagagagaaaagctcggtttaagtcgaaatgaaatggcagataggcttgatgtatcactatctgcgctacaaaactgggaaatgaatgaacgagagcctcaggcttcaatgatcattaagatagcagaatttttaggggtagcacctaactacctactaacaggtgaacaaagccaaccacaagaagcaaaaagcattgtggcacgagcgtttgaagcattagaaaaagaacgtgcagaacaggacgaagttgaaatgctatcaagctttgaaagcattgaagtttcagcaggctttggaagctttaacgtgggcgtaaccgaaccagacgggcaagtaccttacgacagcaaccttctacgcaatctaggcgttaaaccgaagcactgtggcgtattttgggcgaatggctcatcaatgctacccaccattcataacggcgaccagttgttagttgatttcagcaagaaagaagttaaaaataacaaagtatatttagttcaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaaatggcagacattacaagcaagtaagttttgctgaatttcttcatccgtgtataacttcgtcaattcttcaatatcctttgtctgtggagtaggtgagattcttagcaagactttattgattgcatcgagttcatccaccatagtcaaggctgaatttggcttcatcattgcaacgcctgataagagttctgcaagttcttcaaagactgctgcagaaaatgggaacgttggggaatttgtgccttcttgaacatttttcgtatgaattgaaattgccttcaattcggtttcgttgaagttatcccagtttaattctttattcatcgttttaccctccaatgtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcagttagctcattttgttgggagggcaatgttaatggcagattatcaaactctgaagcaaattcttgattacattcactattattgctgattactcgataatctttcggactaaatccagccaatgttaaaccttccacaatattacctagcacatttctaaattgggctgatgctgtgaaaacataactcatattaagcaatgggttgctaaacggtttcgcattgggttggcgtaaaatacgccctacaatttgagtaacatcaatttcagaatgtttatttgcaaggttcgctagaatataagcaaaagaacagtcccaaccttcttttaaggcgtttaccgtgatcacaagacgaactgggcaatcaggcgaaaataaatcaacattttttagttcatctatatcagcagttttgattttgatctgctcggttggaatgtttaattcttcgattaagattttcttaaccttttcaaaagtcgtattatctcctttcgttttcgcttcagcttgaaataatacaatcgggcgaacataaggttcgccattttcaaaggctttttgagcaacttgctctaaatgatgttgaaacgttaccgctgaaatcagtacatcttctttacttgcttgattagatgcattaacaggtagttttaccatattttctttttttaatgctagtgaactgacataagaaatgatattgctttcttttcttggtgtagcggttaaatctaagatgaattttgcatttagattggttagcatttctagcgataaatctgatgtggcattatgactttcgtctacaatcacaacaggttcaaggctgcgaattacattgattagcgaagtatcatcactatcaggcaatgcggtagctttggtatcaaaagaagccaaatagccattttcacgataaattaaacgaccttctttgtttctcgttctaaacgcatcaaaagtcattaccacaatggaaataccgcttttcacggtatctgcatcaaatccacgccctaataaaacatcatctttttcatacacattcacacgcccattaaatagcacatttaatttttgacggtaagggtgatcaggattgcgtaaattccgaatagtctgctctaaaatagccgttgatggcacaagccaaacggtaaatcgtggttgaatttctccgtgaaattcgaccgcactataaattgattgtaaagcattaaccgcaataaaggtctttccgccagcagttggcactttaacgcaaacgtggggcgtattggtaattttctctacatactgttgattaggtacaccttttttcacccaataatttgaaaaggcttgtttcaatttatggctaccatattgatttaattcactcaaatagtcgtttaaatcattaatcacttgtgtttgataactgtttaattccattgcaacacccttatagcttactaatgtctcgcgggattcgtttaaaacggattttaaattgagctaattgctcatccgttaatgtgcatttatccgcatagataacaaaatcttgtggtttttctgccataaaatcggcatttaaactgcgtaaaaaatctaggcttaaggttgttatctgatctgattcgtaataaaaaatatatgctgtttggtaatttaaacctaaaaaataaccgcttgtgtggttatcaaaaacggtttctagtttttcgctatgagcaatatattcacgaatactgattaaatctgcctgattatttaaattgccgtctgaatcaaacaaggtttctccaatggtataaaaactaaatcctccaccagtgcctttttgcgtttctgcttttgaaccgtaaccattaattaccctacggattcgttccgcagtgatattttctgcataatccatcatttcaataccgataaattggcgattgccgccatccttggcgttaagatttaaaactgcgtgggcggttgtgccgctgcccataaagctatctaacacgatagaattaggttttaaaaatgaggaaagcaattcggtagaaaattcattcggtttcggattttcgaaatgaataccaatttctttctgaaatttatcatcgctaccgccaaaggctaaaatagatggggtattttcatataaattttcttttaaaagatatttacttctaggttgcgtaacttcatctgctccaaaaataatttcattattttttaacattttctccattgtaactaatggataacgccaacctttttcaggaataggacactcttttttagttacagggtgaattaatggaataaaatactcatcaggggctttttctttattgggccacgccatagaaacagtttgaaaaatatctccattttcatcaatgaatttataggctttctcgccattagaaaaatcctgttttttaagccaatcctgatattcctgattaacccattctaaatctgcaattaatttattttgttctaaaatttcagtggataaattatattctttgacgacttttttaagattttctgggtattgtttctttccaattttcttaaataacattttcgctttttttaacattgctggggcatttttctttaagcgtttaagtttatgtgttgtatgaaattgatttttaccaaacaatactatgctttcgtgttgataagatattttttgactatcaccttttgggttacgtttatcccaaataattgttccaagatcatttgttttaccaaaaatttcaatcaatatagagtgtaagttggtgtattcattttcatcaatatggataataataactccatcatcagccaatagacgatgtaataattttaaacgtggatacatcatacaaagccatttatcatggcgagataaatcttcaccctctttgcctaccacttcgccaagccattttttgatacgtggatcgtttacattatcgttatagacccatttttcattccctgtgttataaggcggatcgatataaatacagttaattttgccttcatattttggcaaaaggctttttaacgccaagagattatcgccctgaatcagcatattatttttgctattttcaggtttatcgctattcgctttaaaatcgtattgtttttcaagaagatgaaaaggaacatcgtgatgatggtttttgactttatcttttccaatccaagttagctgtggcatacagcctcctcgaattttttagataaaatagagaaaaaagtattgacaaaagttaaaactcgttcacagttgcgttgcgttgcgttgcgttgcgttgcgttgcgttgcgttgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttatctaaccgaaggggaagcggtcgcagatgcgttttattttgcaaatcaagcggaaatggataaaggggtaatagtgtcgtgggaagctcgtcctattctggcgttaatgaaaattcgagcaagggacggacacgctacttttgactccgaatatcaaaacgaccctgtaagtggtgacgatgcgatttttgcgaatagcttgcaatactggacggaactgcctgatgacttgatttattttggggcgttagacccgtctatggggaaagcgggggcaagtcgtgacccgtcggcgattttggttggggggtatcaccgtgcaagcggtaagttatacgtggtcgaagcccaaattaaaaagcgtttgcctgatttgattattgaagatgtgattaggctacatacgcaataccagtgccataaatggtttgtagaaacggtgcaatttcaggaatttttggcaacggagctggttaaacgctcggcacaacgtggcaagcctgtgccagctatggcggttaagcctaacaccgacaaaatgttgcggattgagagcttacaaccgcatatcgctaacggtttgattttaatccaccgctcgcactctacccttgagagccagcttagacatttcccgaaagcagaccacgatgacggtcctgatgctttagagatgttgtggcgtaatgcggtaacagcgtctgccccgattgagtgggagtcgatagatgatgaagattgggaatatcggagtaagtggcgacattaatagtgggcaggtagggacacactgcgtgtgtccgtgaaagattaagacaggcggacacacgcagtgtgtccctacattgtaggataatttatgagcaagaaaaagaaaaaacagtatataaaacccgatttaagtggcgttaaaaacccaaatttacaaaccgatttagccgaaatcacagcgacgggacgggtgttatcggaccatccaagcaattttattacccctgcgaagatgaagcagatttttgatgatgcggaaaatggggatattaccgcccagcacgagttatttatggatattgaagagcgtgactcggcgatttttgcgaatattcagactcgtaagcgtgcggcattgggggtggattgggtgatacaagccccacgcaatgcgacacctgcggaagaaaaactgcgtgatgaagtcgatgagttgttttatcagattggtaatcttgaagatttaattattgactgtatggacgctgtcggtcacggtttttctgcccttgaaattgaatgggcatttaatggcaaggtgtggtatccgaatgcgtttatgcaccgtccgcagtcgtggtttaagtgggataaattagacaaccttttgcttaaaacgccacaaaatcaaacgggcgaaccgttacgctcttatgggtgggtggttcatacccataaatctcgctcgacacagttagcacgcaataatttgttccgcacgctggcgtggttgtatatgtttaagcactactctatccacgactttgcggagtttttagagttgtacggaatgccgattcgcattggtaaatacggtgcgggggcaaccaaagacgagaagcaaacgctcaagcgtgcgttagctgaaatcggacataatgcggcaggcattatgcctgagtcgatgagcattgagttgcataatgcggcaaatgctggcggtgcgtcgggcaataatccgtttttgcagatggtcgattggtgtgagaagtctattgctcgcctgattttagggcaaacgctgaccagcggcgcagacggtaaaagctcaacgaatgcccttggcaatgtgcataatgaagtgcgacgggatttgttagtttcagatgtgaagcaattggggcagacatttactcaacagattattttgccgtatttgttgattaatttcccgaatgtcgatcctactcgtatgccgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagttattggcgagttgcaccaagcccttttgagttgggctggcattaaggtttccaatataaaacttaatagcgtctgcaacttgattacttcttcctgcaataggttgcatatttgccaaaagtaatacgttcttaaattcttcaaagtgatcttgaacacgctcttggacctcgtttagccatttagctgttacaatagtccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggaggacaatttttattatatttcatctaatagcaataggatatgagaggtgaaaaagcaaaagcaatagtgcattgtgatgtggagaataaggtgcatacgatgaaaaaggtgatttgtcatttacaagaggtaggtcgaaacagaacatgaaagttggtcggtaggtggcatgcagaggtagtttcaaggtgacaggttatgaagatatggtgcaaaagacaaatggatggtggcaggcatagtaaaatgatggtgtggaagacatagatggtatttgttttgcatttacggcaccggatgcgggcgataatgacgggaagagatttagtatgtgggacagaatttcggcggcagtattgagaccatgagagtagcaaacgtaagtctaaaggttgttttatagtagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatattaaagcaaaagaatatgatttccagaatttaatcaagcctacatctagacaaggacaaagtgtagataaagaaatgtttttgaaaaaagaaatctatgtgccaaatgagtatctattgaatatttatttgaacaaattaaaggaaatagattctttggtatattcttatacaactgaagttttgatattagaacaaattagagatgaattgttgccgaagttgttgagtggggagatttagaatgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaattttttaaggagtataaaatgacatcaatgtacgcccaaattagcataacagtgaacggaataacaatgaatagaggtattacctttactcctccacaaaacgaccacatcaatatgcaaaagaccgctattcaacatcaaattgaaaagctacttgaacctattgatgctattgagagaatgcaaattaatgctgaaaagcactttgaattaaaaaaatggctcactcaggctttccaaaacgagcttgatgttgctcaacaagaccgctcgccaacataaaaaggcgacaagctaaatctgactgagcctccgcattttctgaaatatgagtgccgtctttatcataaatttcaatatcattgcgtaaaagaatagctgcgacttgtacagcgtttgcaaaagtgaactcagaattactcataattaaatccctatttatgttgtgagaaattgaattatattccttgatgttgtgagaaacaataaggaacttgctgactgtggcaagggtaaaaatcacagtcgccattcaaaaccgcatttagagatccgctaaaggtctgggtaatagcgctgttaccaaatcaaggataactaagccagaactaagtgcggttttgaatggcaacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcctgaatagggtgaagccagaggaaactctggtggaggctcgaagcgatactgacgtgcaaatcgttcgtctgacttgggtataggggcgaaagactaatcgaaccatctagtagctggttccctccgaagtttccctcaggatagctggagcccattacgagttctatcgggtaaagccaatgattagaggcatcgggggcgcaacgccctcgacctattctcaaactttaaataggtaggacggcacggctgctccggtgagccgtgccatggaatcgggagctccaagtgggccatttttggtaagcagaactggcgatgcgggatgaaccggaagccgggttacggtgccaaactgcgcgctaacctagaacccacaaagggtgttggtcgattaagacagcaggacggtggtcatggaagtcgaaatccgctaaggagtgtgtaacaactcacctgccgaatcaactagccccgaaaatggatggcgctgaagcgcgcgacccacacccggccatctgggcgaacgccatgccccgatgagtaggagggcgcggcggccgctgcaaaacccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacgtcaaggtaattggtgaacctgcagaacgtcgtggattgttatcgcaaattttgatttcttggtttccgatgattatgctgattggtttctgggtgttctatatgcgtcaaatgcaaggcggtggcggtcgtggtgcaatgggctttggtaagagcaaggcaaaaatgattgcccctgatcgaatcaaaacacgccttactgatgtggcaggttgtgatgaagcaaaagaggaagtcgctgaggttgtggacttcttgcgtgacccaacaaaattccaaaaattaggcggacgtattccaaaagggattttgatggtaggtcctcctggtacgggtaaaaccttattagcaaaagcgattgcaggggaagcaaatgtgccgttctttacaatggctggttcagatttcgttgaaatgtttgttggtgtaggtgcttctcgtgtgcgtgatctcttcgatcaagcgaagaaaaatgccccttgtattatctttattgatgagattgatgcggtcggtcgtaagcgtggcggtgctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcatcgcaattggtgtattgcttgcatccgatggcattgcttgaacagtaacattatttgaagcaacctcagttaatgttgcaggtgtaccatctgcatttttatatgtatttgttgcaggatcgaaaactttcccttttaagtcactctctttatagaatttaccatcttttccgcgaacaagcgtaactggtacttgtttaccatttacagtttcagtttttacttcgcctgttacagaatctttctcaaagtactcaaacggttttcgatcgttcatttcttttaagcgatcatcgacatagcccgtattcgctgcagccgttctgtctttcgccgtgccgtctggattacgttcaacatcttttaagccagtgatagagcccgtgcctttagcatccgtaccctcaccatttttagcaaagctaatttctggtgctgtgccatctgcccccgaagtaatgcttactgcatctttgccattttggcctttaagtgccaaggtgttagttgttttaccatcttgaccttctttgctagttaagacaattgcatctgcaccgtcatttcctttaaccgttacaccatctctgttataagtcgcagctgatttatccgcttgtgtatcgtctttcggaccaacagtcataccatctgcattgacagtatttttagagtctttatccgttgccgttacgccatctgctttaacggttgttgttaagttattaccttctgcatctttggctttaaccgttgtgccatcaagtttataatccgcagatttcaatggttgattatttgtatctttctgaacaatgcttgtaccgtcagcacctgctgttgcagtagttactttcttatctgcaccatcaccttcagtttttgtggtcgtagtcgcacctggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagaagaagttaatgccatgttggatctcgtcaaagatgaaacgttaagaattgatgcccgatttttagaacccgcttgtggtgatgggaattttttgattgagattttaagacgcaaattggcggtaatagaaaaagattacgccaaatcacagcgagaatatgaattttacctagtgattgccattggggcgatttatggcattgagttacaacaggacaacgtacaggcttgccgtgagcgactttgcaaatttgccgaacaatcttaccgcttgctatttcccgaaacagtaaacgataccgtcatatccgtgattcgctttattttgagtttaaatatcgtgcaaggcaatgccttaaagatgtgctatgtcgatgaaaataatcaggatttagaacatcaaatgatccgtttttccgaatggtcttttttttcttggcggagaaagtggagtttaaaacgccatgattttgaatatcaacatttggtgtttgatcgtgccgagccgtatcagtctattcaagaatatttgccttgttattttttagagatccaaaatgcaaaacctatcgattaactacaatcctgacgtattatcttgtttggcaaatttatctaatgatgaagtgtttacttcgcctgaacttgctaaccgtatgttggatttattaccacaagagttgtttagctcaaaaacatcgacttttttagatccagcgacaaaatctggcgtatttttacgtgagattgccaagcgtttgattaaaggcttagagcatgaaattcctgatttgcaaactcgcattaaccatatttttaccaaacaaatttttggcttagggattacggaactaacttcattattggcacgccgtagtctttattgtagccgttcggcaaatcatcaatatgccctttgtactgaatttgacgatccgcaaggcaatattttctatttacctttgcaacacagttgggaaaatgggcgttgcttacattgtggggcaagccaacaagtttacgatcgtgaagaacatttagaaagccacgcttatgcttttattcatcaacctattcaagagattattccaaattgtcctatgaaatttgacgttattatcggcaatccgccttatcagttgagtgatggtggggcacaagcgagtgcgaaacctatatatgatttatttgtagagcaagctaaaaagttaaatccacgatatttaacgatgattattccttctcgttggttcactggtgggaaggggttagatgcctttcgtgacgcaatgctttcagataatcgtatttcaactattcacgattttccgaattcacaagattgctttacgggagtagaaataaaaggtggagtttgttacttcctttgggatagtcattacaagggagattgtaaggttattacccatgctaaaaatgaaattgtctctgaaatggaacgaccgttaaaagaggaagggctagatttctttattcgttataacaatgcaattactattttaagaaaagttgctgaatttaaagaagaaagttttagccaacttgttagtgcaagaaagccttttttcttccctacaaattttaaaggaaaaacgaccgcttatagaggtattgataatgtaacagtctatcaaaataaaagtattggttacgtgaaaagagaagatgttgttgtaaataaacaatggattgatgctcataaattatttgttcctaaggcaataggctctggcgatagtaaaactgactgggtcaagccgatttatgcaggaatgggaacagtctgtacagaaacttatttgttaataggtacatttgatagtcaaaaaacgtgtgaaaatgtgatgagttatatcaatacgaagttctttcactttatgttgacgataaagaaaaatactcaagatgcaacaaaaaaagtttatgagcttattccaacacaagattttactaaaccttggacagaccaagagctttatcagaaatataacttaacggaagatgaaattaactatattgaagcgatggttcgtccaacgggagagaaagaatgagtgaatttatttctgaattacgtaccccaaaagtttacgcatatagcgacagtcgtttcccccattgcttaaaaatcggctataccacaagagatgttgcacagcgagtggcggaacaatatcctgtgaaattgcccaatcaaagctatcaagtggtatttgacgaacgtgccattcgtgatgatggttcaagttttcgagattacgatctccacgctgttctgcaaaaaagaggggttgaacgtttagagggcgagtggtttaaatgcgatttaaacgatgtgaaatctgcttatttagaggttaaaacaagacaagcggtcgaaaaaagccgaatttttgcctttggaatgcgacctgaacagcaagaagcagtaacgaaaacggctcaatactttcgttcgtttcacaacgatgaaaataatcaagaaaaaacaccacattttttgtggaatgccaaaatgcgttttggtaaaacctttgctgcttatcagcttgccaaagaaatgggttggaaaaagattttggtgctgacttttaagccagcggtacaaaatgcatggcaagaagatttgcaaaatcaccttgattttcaaggctggcgatttgttacccacggagatgaatggcaaagtgcggtggattttccacaaatttgtttcggttctttccaagattatttgggcaaaaataaagcaggcggtacaaaactcaaaaatgagtgggtacatacaatcaattgggattgtattatttttgatgaataccattacggtgcgtggcgtgaaaaatccaaaggtttatttgaagcggaagagcaggcgttccaaaagcaacttgaagccgaagccgccgaaatggaaatggatatgcccgattattttgatgaagaaaccttgccgattaccagcaatcactttttgtatttatcgggtacacctttccgtgcgttaaattcgggcgaatttattgaagagcaagtttataattggacttactccgatgaacagcgagccaaaaaagcatggcaaggggaagataatccttatttaagtttgccaagaatggtaatgcttacctaccaattacctgaggatattcgggaagtggctttaaaaggcgaatttaacgagttcgacttagggcagttttttgaagcaaaaggaacaggcaaaaacgcaaaatttaaatatgaaaatgaagtacaaaaatggcttgatttgattcgtggtgctttgcgttcaaccacaatcgataatctcaaattaggtgcagaaaagccaccaatgccttttggcgacagccgtttattaggcagtttgttgcacacgctatggttcttgccgtctgtggcttcctgttatgccatgcggaatttattgactcaaaagcaaaatcagttttatcacgaatatcaagtgattgtcgccgcaggtaatgatgcaggcatgggggcagatgcgattattcctgtacgaaaagcaatgggtgaaccgctgaacagtaaaaccattacactctcttgtggcaaattgactacgggtgtttctgtcgcaccttggacagggatttttatgttacgcaatttaaatagccctgaaacctatttccaagcagctttccgtgtgcaaacaccgtgggtattacgtggacacaatccaaacgatcccaataatgaatgtatcgtcaaagaagattgttatgtgttcgattttgcccctgaccgtgccttaaagcagttggcggattattgtgtgcgattaaatacagacgataaaaatcctgagcagaaagtcgcagagtttattcaattcttgcctgtgcttgcttatgatggcagttcaatgcgttctattgatgccgccggtattttggatatggcgatgagtggtacaacagcaacgcttttagcacgccgttgggaaagtgctttattggttaatgtcgataatgaaacattaagtaaattacgccacaatgaagatgccatgaaggcattaatgagtattgaaggttttcgttctttgaaccaagatattgaaaccatcatcaataagtcagaaagcgtgaaaaagacaaaaaatgcagcgaatgatcgtgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttgcggatcgataacgatagcattactactgccttgtaacctaaaataaggaatgttatgaataacaccgtgggcgtgagccttaccctctccgtcaagctgtgcgaccattggctgaacatctaccgttccaacgggtgcaacgcctgtcgcatttactgctttaacttgaactaaagtaacggtttgtatgcgattgattaaactaccaacaataaaaccaagctcaccaactcccccgctactttgttcttccgtcatttgtccgaatttattttgcaattttcacccccgcatctaatcttgacgcatcaatagcactaaaccatctaccaccagcgatttcactttctaggtaatgcgttaagccatatattcgccactgcccgtttgttgattcaatcaggctattcctaatctctatttgcccgttatgtttgattaacggatcaaataaacattgcaaactaaccccttgtagtgttggtgttggatagccaattaaaccagtttgaggagagataataggtacttttatattccgtggttgccctcttggagtaatagcgattgtattaacttctaaagtcacagtggcatctactgctttacaaagctctgtaattttctctaatgctgtttggggcaaatatgcgttactcacttttgcagtaacaccactattctcaaaacgcatatccattgatttgcatatttcagagataacgcctgcaacatcaacctcgcctttaaaacttaaaggttttgccggtaaaatttgatgattcattgcggtaacagaatctaccgtcaagataacctcaggcgctgagccatagttaggataagcaaacgtaattgtgccaaaataaacggtcgtgtaagtttgcccaccatcagaacttgcctctaacttgatagaattcagcttttcttgttttatattccacgatattttcgatatacgattcattacattttggcttaaaccataaatcataatcttcgcgttaggttgtatagcaccatttcctgattgtattgtggcagatacccttaaattttctgcaacaatcgtattattcttatcatcaaaattaagccctttctgtccgagtgctatcgttacccttaactttttaacagtaaaactccccatcttaccgctccacaaaaatcaacttatatcttgttcctaacgcttggtaatgtggattttgtttgccttgcgtatcgaaaaaagcaagatttacattgccaatattaagatactccacactaattaaaggcgtgcgatctcggcaaattctgttattcaagatagatttaccatttgcttttaaagatagataaagctcttcattcagccttgtattaagttcaatatcaaagccaacgccaccaacaaccaccgataacgattgattagggatatttttaactggtacttcataaatctttaatgtcatttagtaccacccattgattctttgaacacttctacaacatctccagctaaatctctctttgttccccaaaaggctttttcttctacgcttttagttccttttaaaaggatagaattattcgagccagaagtagaaccaacatcttttgcagaaacttcgccttggttttgcgttggttccgcttgcggagcttctgtttccgtgtattccacttcaacttctcttacttcttgcaagtgtaaattgacttttagcagccttgctccatcgccagcttctcttgcatagtcatacccaataatgttgcaatttgggtaaatggcttcgggcgtgattaccatatataaatccgtgctattcgcaaacgcatcaacaagggctaaaaatgcactccgctctgctacgcccccactcccttttgtcatcatcacatcaacagtataaggctctataaccttgttataagatgcaaaagagccttgctccaaaggtgcattagaaatcttcgatcttgtttgatacttaacggatttcacgttatcagccagtaataatggtattccgttctggttaaatatgccccaatagttaccaaagaacatatttaccgctaagccaccaccgaattttatggctgcatcaccaatgtttttgggtagcccaggaacacttggcacaccgattgagttccacatattttctccaataaaaaaacccgaccatttctgatcgggttgaatttcaggtacaacaaaagccacttgcaacgcgaggtcgcaagcggttagttatggttaaaattttggcaatattgaggggaataatgtcgtttaatttgccacctgttaccacatattacttgtattacaattattaccaccctatacttactccaacatcttaatgtaagaggataacactatggcattgaccgtaagactaccagacgaattacaacaacgcttagatcatctctccgtccaaacagggcgagcaaaatctttttatgtcaaagaggcattagaagcctatttggaagatttagaagatttactcttagctaatgcggttcttgaacgtgtccgttcaggtaaagaaaaaacctattcattagaggaagtcgagaatgagcttaacttggaacatcatcttagcggaaaccgctaaaaagcaattagccaaactcgctaagaaaaatcctcaacaggctcaacaaattatccgctatcttaaaaccttagctacgctagaaaatccacgagatcggggcaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaatgaataaataagaatgtgtaaaacatttgagaaaactccaacggtaaatttttaacatctaccgcaagtttccacgcttggcggtagaacgtatcggggtggaaaactgttaccattggaaaaacagccaatcgcaaggattgcccgatacgccctaccattgagagaaagctacgctccccatttttcgggaacgttttttctttaggtgtgcgtgtgctacgaacaaaaaaagcacgattaaaaggcgtgctactgttcgccaatggttcattattcgagtttccacgctcggttgtagattttgccacaacgtgaacagaataaatctcacttagcattttgtaaagtgaaatgttttcattaagattgatttttaaatgaaatagagtaatatctctattgatgtttacaatatggtttttcataagtatgttaccccattgccccttagtgtttaggctaaggggctttgttttatgccaccattggcaaatgattgcgtaagaaatacaaggcagattgttctagctttgccttgttcgtcgatatatttagcctccttaaaattaaggtggcgaaagttcattaaatctcaggttttctcaggttctagtgtttttctcatttttgagtaaaaccctaggctgtactttcatttggtgctaccaactcaataaccgtagggcgaagtgagccgtcagagcttgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcagttgccacgttgcctgcgacaataggtaagttcgggtatttcgcacgggtttcacgcacacgttgtaacacaccctcagagtgaccgtgggaagagtcgataagcaagacatcaacaccagcctgaacaagagcatcaatacgttcttcattacctggaccagcaccgactgccgcaccgacacgcagacgacctaactcatctttacaggcgttcggtttttgttcagctttttgataatctttaacggtaatcatcccttttagtttgaagttatcatccaccattaacactttttcaactcggtgatcgtgcataagttctaaaatttcttcacgattagccccttctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggttcctttgtaataaatagagtggggtgtagtaggtatctattacgttatttgcaataggatttgcgtgttgaatgatggcggatatacccaagagtgaaagttgcacatagcacatctgaacactttttaagtcgatatcttgcgcaataacgagtaattgttgctgcggattatagccttgtgattttaatgtttcgcaaaagctgataattaatgcaccgcttccgcaagtgggctcgttcagcgtgaaatagcctttctcgtctatttcgcttggggcaataagcatatttgccatcacttgaccagtagaaatgggcgtaaaacattgtccacgttgtttgttggcaatttgtagcttcatatagcattggcctaacacatcttgaggttcttcttctaaaagattaagaagaatttgtcccagctgatgaaattgatacatctcatcatcggtgtagcgtgatttaatggagaagtatctttcatcacgatcttgaaagggtttgctaatggcacaagcacagatttcaacaaagtcttgaaacactcttaaattgtcatgtttacgccccattgtttggataagagaaagcaactcattcacattagatattctccaaaagcgcagatagtgccgcaggctctactgcaaaatcccaatacattgtgcttgaggctcttttgttgtcgggatctgaattgatgtttacttgggttttatttttaggcaatatctctctagggagtaggagaatacgatagccactcggtgggccatcacttttttcaacttcatcatctgaagcaaaaaggcaaaagaaatccggtaagttatcaggatcgtaccttaaagcatattgattcgagcctctaactttcctaaccgaagaatacttcacgtcaatctctttgttgtttacaacaaaatcaaaacgaggattattcatttgatactgcatattcatatcaatagcagaagggactaaacgtttaaattcattctccgcccaatctccttttaaaccagtttctgctcgctctttataactcgcccagtttggggataaatttaactgttcaagggtttttgccacaatccacacggtcaaaccaacatcttttgtgatttctttaaggtcgccattgtgtcgataataactatccaagacgcgatattgtgttgtttccgtttgtttaacaaaaccgtgatactttaatgtaaggtaaacgatacctgcccgcagatttaaggcgtcagcaaatttcgctacatccgcataggacgtataatgttcttttgccattttaagcaactgctgttctttgtctttatctgcgataattcgtcttttttgtggttgcaaataaggctcaatattttctatcattattaactccataaaaaaactcacctagatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaagggcgttaggttttggttctttaactggcgtaggactgggcttatacgctgcgtcagaaggttatgtgccttatatggcaaggcaagaagccgagaaagaaaagcgagcggaagcagagaaaaaatttagagcgcaacatagtagtaagccgtcggcatttacttatgggaatgcggcaatggggggcgttaagcctgagcataattatcacggtgcttatgtgattgcaggacgtttaaatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttatttaagcagtatcagggcaaacttgataagccataccaagagctaaatgggttgcataatcgtatttttgagtcaaataacaacgccactacctcagtgacggtagtgagggaggaaaaagatgaaaattaaagtaaaagcaattgatggggtacgagtaccatttgagaaccacccccatagctatatcgaacacgagccagtggaagttgataactcaatatactatcagcgtcgtatcgctgatggtgatttaatcttagtcactggtgtagataaacctaaaaaagagagtaaataggaggggggaattattatggttgattttgacaaaatcccgaacagtattcgtaaaccaggagtatataccgaatacaataataaagacgctgtgaccaccttgcctacgaatgagcaagaagtgttgatcgttgctccgatgacggctcaagcaacaggaaattatagcttgcctgtcaaagtgtttagtgataccgatgctgaacaggcatttggggctggctctgtagctcatttaatggtgcgtcaggctattaagaataattcactgattcgcttaacggttattggattaaaagaccattctgcaggtgttgctgcgacagggcgtgtgacttttacagggtctgcaagcattgctggtgtggtgcgtgttgttatcggtggggaggcttatgaaattgcggtggcaaaaaatgaagcgaatactgccattgtcactcgtttggtggctgtgattaatgcctctcgttatagtcaagttgttgcaagtgcagaaagtgatggcgtattgctattgactgccaaatgtaaaggtgaaattggcaacgaattgatgttatcagctaaacacaccgctgggactttaagtcttgctgtcactgcatttagtggaggtcagcgtaatgcccagattgcaccagcgttagcaagtgttgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacgaccgactaatcctgcatcactcaaaaaggctaaggcatcttcaatcaccgaccattcggtttaatgattttgtcgttctagctgatgatatttttcacgaatggcttgtgaacgttcgataatgtgttggaaatccataatgttccttatttattttacagtttttgttccatcaaggtttttaacggttcaagccccaagcgttcatagaaacggaatgccccttgattgtcattccaaacgtgaagtgtcacactgtcgcaagcgtttgctttggcaaagtccaccacatactgatacaacttctcgccgattttcttgccacgttgtgacgcatcaacacagagatcgtcaatgtacaacaccttgcgatcaaataaggctggaatgccttgcgtaatttgataaatgcagaaagcatagccttgcaccgagccgttttcatcttcatacacaaagatcggtttttgttcgtctgccattaaggctaaaatttcttcatcgctgtacttgcgtttacccgcttggaaaatatcagggcgagcttcaacgtgaacagcgtgaacttggtataacaactcggcaatacgagcgacatcatcggcttttgcaggtctaatcattgtttttcctaaatcgtgtttaactgtgtagcaagttgatttaataccatttcggtatcatcaagcaactgctcaaatttctccataccaaactgctggcttacttgcaattctgcttcggttagtcgagcaataatcgggtcgataaaaattttaccgcttgcacttaaagcaatcagcttactgcgtttgtcgttctcatcaggcagaaaaaccaaaaaacctttttggtcaagctgtttgcaaacagaggttaccgtttgtttcggcaaactccatttatcgccaatagcagtaggcgaagtcgcaccatagcgaccaatggaatacaaaaaatgcaattcatttaaggtgagctggtgttgcttcgccacactagcataaatgctcgacagctgtgctgctagctccaccaatttatcaaaggggttcatttttacgctccaaaaatttgacacgagtgatgtcataaagccagttaaacaccaaggcatacagcataatcagcaaactcaaaccaatatccgctaaaaaggcgtgccacaggcttaaatctaataaatatgcaactacgggaatggtaaacagcaataaggtacattcaaagcagacggtatgcaaaatgcgtaattttagactacgttcttcccgcttgccggtaaaaattttatcaaacacatagttaaagaagaaattaagtaccattgccatcacagacatggcaacccccgttccagccgcagcttcaaggctgaaatccccagccaataacactgcaaccgcaccgattgccattgctccaatttcaaataataccgagtgaaaaatacgttcgtaaaaagtcataaaataatcctatatcgtactaaataaatttattttagtacggtataggagtaaatacaactctatttgcaaatttctaagtagatctcaccgctttctaatctaacgctttaatcccttgaataatttggcaatggtcaatgtcttccgcctgacagtcaattaatggctcaagcaatactttaatttgattgagctgatcgatttgatgctcaatttggattaaatgctgtttcgttaatttatccaccagttcgcaacgattatgtggattagtttgcaacatgattagttgtttaatttcctctaagcgaaagccgatcatccgacaacttttaataaaatggagctgattgagctgtttttcactaaacaagcgatagccgtttggttgccttgttgcagtatcaattagccccagtttttcatagtaacgaatggtttccaaattcacgccactttctcggcttaattcacggattttaaaaaattttgccatggatgcttgaccctgtaattgctacggagtttatagtttacgccaagttaaacaaaaacacacggagagactatggcttgtacgacttcttgctgtacttcacacagcacaaacctttccccgaaatatcgcaaagcattatggattgctcttggactaaatattactctgtttttcattgaaatcgtgatgggcgtaaaatcgggttctgtttctttactttcggatagcttagatttttttggcgacagcgccaattatgtgattagcttgatcgtgttgcccatggcgttaagttatcgtgctaaagcctctttattaaaaggagcaaccatgggtggatttgggctatttattttaatcacaaccctctatcgttgggcttatggcgaactgccaaaccatagtgaaatgagcgtagtcggtgtgcttgccttattcgccaacctaacagccttgtgggtgctttatcattttcgtgatggcgatagcaatatgaagagtgtttggatctgctcccgcaatgatgcgatagggaatattgcggtcattttggcggggattgcggtctattttacccagtcgaaatatcccgatttgctcgttgctttcgttttggctttattagctctgcaaggtgcgagagagattattgttaaggcattaatggaattgaaaggataagaaaatagcggtgagattcaatgaaaaatttgcaaatttctaagtggatctcaccgcttgttatcattattccctatatctagggtacttctgtttatcttcttcagtaatcgctctcactactcggcatgggtttccaacggcaataactccagccggaatatctttagtaaccacgctaccagcgccaataattgtatcattaccgatagttacacctgggagaacgactacattggcaccgatccagacattatccccaaccgtaatcggtaaggcaatttccaagccttgattacgttgctcactatcaagtgcatgacccgccgtagaaaaaacacagttaggcgcaataaacacataattaccaaaggtgatcggtgcggcatctagtaaagtacagttataattgctgtaaaaatagcgaccaagccgtacattaacaccgtaatcgcaataaaatggtggcgtaattaccgtatcttcttttatctcgccaaataatgcttgcaaaattgcctgacgttttgcggtatcggatggtttgcaatgattaaattcaaaacagagatctgcagccttgaatctagcggtaatcaaagtgtcgtcataattcgcatcatataaatagcctgcttgtgctttttcccattctgtcatgttcgttcctttgtctaacctatatatctcaattataggctagttgtattgaatacaaagcagatttagataaaagctaattttattttttataaggcatctacataatcaactaacagtttaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgttgcgttgcgttgcgttgcgttgcgttgcgttgcgttgcgttgaacatttttgagatccttattttagtatgtcaagtaataattactgtttctctgaaatttctttaaaagaaatcgagaaagcatcttttaagttttctggcatcgtgcgatagttattaagtaagttttcttcttgttctgacattacaatttcttgtgttgcaatctgaaacatttccccttcaccactcacgagccagttcaaattcactccagctttggcgataccagtcataccttccgcatttggctcacgttcaccaccaacataaccttgtagggtgcggtaagcaattcctgtttgctctgcaaagtctttaattttccaattcttagcttcacaaacttgtcttaatctttctgatatacacatttgagcgtcctattttcaatattagattgacaaataacgcaaacgagcgtatatttgacattgtatagggtatattttatcacgtttgagcatagattaaatatcctataaacaaatttttaggtaatttcaagacttttatataacaaaaagaaacgactcaactatggcatctcacttcctattaaccagcaaagctcgcacgctttcatctattaagatagcacgcctatctgatgatgaagcatttagcttattgtgcgagctacgttggggaagtaaagaagtggtagtttgtcctaaatgcggtgtacaacataaagcttattttatctctactcgcaaacaatggcgttgcaagcattgcaaacacacatttagcattacatcagggacaatttttgcaaaccacaagttgccgattcaaacctacttattcgctattgcgttatttgtgaatgcggtaaaaggcatttcagcttgccaactttctcgtgatttgaatgtacagtacaaaaccgcttttaccttatcacataaaatccgtgaaagcctgattgtacaacgtgagctttttccgctgtcaggtgaaatccatattgacggcacttacgtgcattctgctccacgcccaaagaataagaaaagtgaacgagtggatagacgtttaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaaagattgcttgcatttcatcatagcttaaacctaaaccgtcttttaagaactggtaagcttcacagattaactgcatatcgccgtattcgataccgttgtgtaccattttcacgaaatgaccggcaccttctttgcccacccagtcacagcaaggctcgcctttgtcggtttttgctgaaatcgcttggaaaatcggtttcacatattgccatgcttcttcattaccacctggcataatcgaaggtccgtgacgtgcgccttcttcaccgcctgacacacccgagccgataaagcgaatacctttttccgttaacgctttcacacggcggttggtatcagggtaattcgagttaccgccatcaatgatgatgtcgccttcttctaagtgcggtaataatgcatcaataaattgatcgaccacttcacctgcacgcaccattaacatcactttgcgtggtttttctaatttcgcaactaaatcttctaaagaatacgccccgataatatttgtacctttcgccgcaccttctaaaaactcgtacacttttgacgtagtacggttatacgccacgactttaaagccgttgtcgttcatatttaaaataaggttctgacccattaccgctaaaccgataacgccgatatcgccttttactgacattttttgctcctgttggttttgattctgtaagcggtgaaatttgtaaaattttttgcaaatttaaccacttgtttacttatattcatttaattagagtcatgggtatttctaccgtctggcgtaagctaactagtaactgttttcccattatagtttactgaattcttgataatctaagagaaccatccgatggtaataatattctatattttacttcctgattttcttttagttgaactgtatctgtcatttcaatatctggacacattcctcctacagaaatttttattatatgttcgcctgaaaatgtataaaatttaataaattcaccactttttaacgttgcaattctttggttatccataaatacgtgatgatcacatgcagaaccaaagaagccagaatctctaaaaacggtaatagtcccactgtttgctgttttggttaataaagaatttgtatatattctatctttggaaacaaaaacacctgtactttctgtaattggggtagttgagcatcctgttaatagggcaatacataaagctagatattttttcataaataactccttatataagttacgcagaataaaaaacactataagaaataaattctcctattttctattcttaatttatctatcattgtcgctttgatatatgcttttcagacatttaaatactgtctaaaatttcttttctacgagaatcatattctgattgagtaattagccctttttctaataaagtagataatttatttagcctatcttcaagagcttcctgttgtgttgtgatattaatggaagtagctgctgcacaagctgcattaatatcattcataagagaaacttcatctacagtagttactccttcagagtttctagttaaattggagtaaacccgccctaacgctaaagtttgttgctttaattcagcattagttggatcatcctttagcatccttaatgattcttcataattttcttgagctattttaagctgctttgattctgattttaatgaaataacaacaaatacaataataagaatgataataccaacaaaaatttccatagtgtactcctaataaagtttagtaaatataatatttgccaccaacgccaataccgctggcaacccttgtttaatcaaaatccctttattctttgcacttatcgccccataaaccgcagcgacaatcacacaacttaagaagaaaaaagtgaccgcactttgttgaatacaaagagaaaaaataatccctgcggctaaaaatccgttatacaacccttgattagcaaacaacaacagaatttttggatcggttgccgtttgttcgtctaaattaaaaattttctcgccttcgggctgtttaaggcaaacatttctaaatacataatgtagaaatgctcaagggcgacaagggtggttaaaatatacgccagtattgacattgttttctctctatcttacaagtggtgcgttttgcaaaattttttgcagttctgaccgcttgcttattgttcttctaactgttctaaaattttactggttgataagtccattttagaaaaggcaaaccattttttgcctaaatcctttaatgaggcaccgatatggtagagttcggagcgatctaaaattaaaaatctatcgtgtgattgactaaacggttttatcgttattggttcatattgactattatagcgttctaaatcaagtgataactgtctgctgattgtttttgtataaagtgtgacattaacacctaatttacgtttactaaataatgttaaaacagaatcatcaagataattatcaatcaaaataatagaagattctgcttttcttactaaatctgctacaaaagtataggcatcaaaggtttcgccatcaaaaaagataccttgagagcgaggtttatttccttctagagctaagaatacctgctccaattgcccagacatttcaatctgcttgcgttctacattttctagtcgctgaataacacccaggttatttagcaatgtatgccgcatttgcacaaaagcctgcataattgtaatgctgacttgaattgcaacttcactacgcaataccgttgagagcattgcaataccttgttcggtaaatacatagggtaaatattttctatgtttaccctttgcatttttattttcttctttctctaagatcacaaattgtgatcttagagattgccactcactttccatcaattgaaaacgaaattcctctggaaagcgctccaaatttcgtttaaccgcttggttaaatgttctcgtttctacttgataaaggcttgccaaatggctatcaatcattacttgaacatttcttaccgtaaaaatttgtgtttccaatttaggattaatttgtactaattggttcatcttttttccttcagcattttgaggtcacaactcgtgatttcaaatagaaattaggatgagccattttccaaccaagttctaatacttttttatgttttttcgacacagatcgcaaatttaaattttaaggtcacaatttgtgaccttagaggcactgaaaaatctatctagcttgccaatatttctgccattattgctcactatgattttgctcaaaaatcatcttctgattttcaatttctcgcaccaactcttcttcgcttggcaaatacgccatatatttgctggcaaaaagctgcgagctgtcgttcaataccgaatatttcgccaccacgctatcggtttcggtgcaaagtaacaagccgatggtggggttatcatcagggcgtttttgcaaatcatcgtacattcgcacatacatatccaattgcccaatgtcttgatgagtgagtttttctgttttcaactcaacgatcacaaagcattttaaaatgtaattgtaaaagactaaatcaataaagaaatcggacgtttcggtgcgaatacactgttggcgagccacaaaagcaaagcctttgcccagttccaacataaattgttgcagattatcaatcaacgctttttctagctctgcttcggtgtatgccaagttagtcggtaaattcaaaaattccaatacggtgggcgatttaatcaaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcggccggctacggcgcgtcggccgagcaggctgagccaatggcacgggcccttggggcgcgaacgccctaatgtgggtcggggcgagcggcgggcacaggcgccggttgctagcttggattctgacttagaggcgttcagtcataatccggcacacggtagcttcgcgccactggcttttcaaccaagcgcgatgaccaattgtgtgaatcaacggttcctctcgtactaggttgaattactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattttaaagggcgttattcttagaatttatacactaagttatcttcatacttgccgctataacttgtagacgtattgattacaattcgctttgctccatcgaacgcctgccaattatccactttatcttcctgcatatactcaataaatcgaataaactccgatttcgttgaactgaagaagatataaggtggtttggttagattaataagccttagaaagtcaattaaatcaaaataggttgcctgtttatagctttcctgcttggtgcaaagatagggtgggtcaaggacaagcaataccttttccttacctgagaagcgtggcactaattgatgaaacgactcacaaacaatctccaccccttcaagataaccatcagcacttggataatcgctctgccgtaagcaatgccagaaatcttgagcatataactcttcaaggttcttcacttgctgaccactaaacaatagccaagaacatagaatatgtgggtctttatatcccttaaacgcttcaataatctcaatcagttgtaattttttcgctttatctaaccgcttacctttggggcaatcagcaagggcaatcgctaattgttggcgtaattgattaatgtcggggatatgttgtaagcgttcggcatagttgtcaaaatcgttgtaaatcaccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtacagcaatttttaaatatgaaaagacaaatgataacagcacttgaagcagtgaaagaaatggaagagttagggggaacaaatgcaacaaaacactaaaccagcaccctatttcaaagcacagtcaaaacagtgtgaacgtttgagtgattggcttatcttggtgggtgaaggggcttactacgcttattttgaccgtaaaaaacaagctggcaaaggtgaacaatcgcaactaatccgagatgcttatcaattttcaacagatagacaaccagtgattttagacagcaaaagttttacagaaattgaccgcttgttgcttgctccaactgaacaggcatttattaaaatctttcaagtgggggaaatccccactttatcagaaggtaatgacctaaaaagccgtattttgttaaatctatctaagcataatccaaatgtaaaagcggttgaatggttggatgtatcgttacaatctgaaaacttaaccccacaccttgaacgaatccgaagcggtgaaagtgttgttgctgaagttctgcaaaagaaaggtagtgaaaaagtaaatattgacttaaatcaaagcaccttaactcaaaaagaaattctggccgcctttcttaaatggcatactcaacctttacgccgtgatgtcgttcttggcattacctaccaattcaacggcataaactgggaagtagtcagtgatacagttttaaaacgaaaatgccttaagttttatgaagcctttgatggcaattatacagcgcatcgtttgaatagcttagctgaacttattaccatcaaaataaaagaaatgccagtagaaaacccagactacttagggtttcagaatggcgtactaaacaagaaaacaggggaatttttgccacacagtgaagagaactttttgcgaacaatagatccttttgaatgtcggacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttggtttcttatgcaggttctgactttgatgttcgttcagtcaatgctaggggtaagcgttatcaggcaacggatacctttgtggtgttggtgatggctcgctctatgcgttccgccgttgcggggcgtgtaggtggcgttacacagcaagaagtcggtgtaaatctgttgcttagtgcggtgaagtatttgctgattaatcaaactttagggggattggtgtcacctatccaacctaagcgaatccgtaccatttggaataatgcggaagtgaaaaaagagaaaatctctgcttttgcgattgagtttgaaatgagctacaccgaaaacggctttttagaggatgggagatttccagagggaataagtgagcttgaacagttatttaagcagtatcagggcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtggaagattttgtgattaagccgtttgagcagggggggaagtgatggattggggaagtgttatttttctaagtgtttttatcgcttgtatgtcgtgggttattgttacttttattaaacattaaaacctatttaaggaaagtttatgactaaagacgagattatggctgtgctgaaaaaaaacggttttaagttagagcttaatgatggtgtagtttttggttttatcaaaaacaccacaaccattatggttagtatgcttggggcaaatactactttttcagtgaaattcaatggtcaaggaaataagcacaaatcaataaaattgatgaatagactatttccaatggctttatataaagagattaatactcctattgcagcaacttatttctatttagatgaaactcactagatttatttaaagctcatttaaacgctctttaaatcccctctccctccgaaaatccttgcggattttctccaccctctcccgcaagcgggcgaggggaataataagaagggcgttaataatgtgttttaaccataaggggaaagatatgaaaaagaaaccagatacactcaaacgtgagcggtttaagtattttagtgagcttgcttcaacacttgagcgtgaaggcaagtatttacaggcaggagatgcgtgggataaggcgttaaagtttgcgactaatccacttaaccaaaagtggtgcgaaagccgttatgagttctgtgagaaaagagcttaaggggtaattatgactgatagcgaaaaaggacaaataaaagaccgcttgtatgacctgattgaaaagctacaaggggcgacggaattagtcgaaatggacgatttggcactggctggtgtggtgttgatggacgtggctgggcaaattcagcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccctgcagatgacattacaccagtataagaactcacgctgacagagtattttttaccgttgaaaatgaattcttgtttttggtctttgttggttttaccgtaatcattcatcgtgctagatagcatctccataaattttttacctacggttttaagttgattttttccttcaaaggcagaaagtacggctgcatttgagaacagcataaccatattttcatctccaccttctgatttaggtgtcacaatcgtgagtatgctcatcactttttgtgttttcttatcgatcgccatcacaattccgaaattttttgagaattggtagcttgctgtatcatttaccgcccctttttctacttttattttctttgccatttggtaaggcgaaccaatttctgttagggctgtgttaatgagttgtgctaattggttggcgttaagatctaaggtttgattaactttttcaggctcagcaggttgtttttctgcgttaggttcttcttttgttgctacttcaggggctttttcttctgctgctggagctggttttatttcttctttcggtggcgtagcaataggttcttttggttgttctactttggtggtttcttctggttgtactggtgctggggaaatgattagtacactaatgacaaatcctaacgcaccaattgcaaacccagctaaatggcgaacaaatgctcctttgcctttattcttataaaatcttgcaataacaatccataatgcaataaataaaataaatggaataaagttaatcattttcaagtttccttatagttggttaaaaaattctacgctactttacgattcgtaagtgccgccgtcgccgccaaagcacttgcggcttcttcgatggcggctttaccctgctcgttgctttctcggtagtcttcaagtagggtttgttctttttgggtgagcgtgctttcaggtgtgctttgcaccccagaaaagaccctatcccaaattctgtgtaaacacccatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaacctcctctcaaatcagcgatatcaaacgtaccattccgtgaaacaccggggtatctgtttggtggaacctgattagaggaaactcaaagagtgctatggtatggtgacggagtgcgctggtcaagagtgtaaaagctttttgaacagagagcatttccggcagcagagagacctgaaaaagcaatttttctggaatttcagctgtttccaaactcaataagtatcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcagaattacctatcgcaacggaatttgccccagcagctttcgtgttaccaccaagagtaacagaattagcactagacaaactattattccctatcgcaacaccatgcaatcctgttcctgaatgtgctctataacctatcgcaacattagtcctaccttcagcttttgagtgctgaccaatagcaatagaaccatgcgcaaccctactatcttgaccaataccaatagaaccatcgtcaactcctccactcgcttcaccagcaccatctagaaaaagccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaattccgcaccttaaacagttcaaaaggcccagcagttcgagcaacccgcgcgcaagcagatcgtgtactttaccgccaagcggtgcgtactgcattagaaaatcagccaaatttagatattttccaacaagaagtcgtggatattttggttgaaaataaccgtgcggttggtgcagtaactaaaatgggtttaacctttaaagcgaaatcagtgattttaaccgcaggcactttcttggcgggtaagatccatattggtttagataactacgcaggcggacgtgcaggtgatccagcggcaacaatgttggctgatcgtttacgcgatcttaatttgcgtgttgatcgattaaaaacaggtacgccaccacgtttagatgctcgcacgatcaattttgatgtattggcaaaacaacacggcgatgacgtattgcctgtaatgtcatttatgggatccgttgagcaacaccctcgtcaaattccgtgttatatcactcacactaacgaacaaacccacgatttgatccgtaatagtttagatcgtagcccgatgtatacggggattattgaagggatcgggcctcgttattgcccgtcaattgaagataaagtaatgcgttttagcgatcgcaacagccatcagatctacctcgaaccagaaggtttaaccaccattgaggtttacccgaacgggatttcaaccagtttgccgtttgatgtgcaaatggggatcgtcaattcaatgaaaggcttggaaaacacccgtattatcaaaccaggttatgccattgagtacgactatttcgacccacgagatctaaaaccaacccttgaaaccaaagcgattgacggcttattctttgccggacaaattaacggcacaacgggttacgaagaagctgctgcacaaggtttattggcagggattaacgccggtttacaggtacagggaaaagaagcgtggttcccaacccgtgatttagcttacactggcgtattggtagatgatctctgcactttaggcactaaagaaccgtatcgtgtatttacttcccgtgcggaatatcgcttgctgttgcgtgaagacaacgctgatgcccgtttaacacctattgctcatcaatttggtttaattgatgaagctcgttggacacgctttaacgagaagatggaaaacatcgaaaaagagaaagctcgcttaaaacaaacctgggcacacttgcaaatggcaaatcttgtagaagtgaatgcattattaaatagcccactagcccgtgaagcaagcggtgaagatttaattcgccgtcctgaagtgacttacgaagccttaactcaaatcgcgccttttgcgccggcgattgaagattaaatatcaaggctatatcgaacatcaacaacaagagatcgaacgccataaacgccacgaaaacacgcaaattccagctgaatttgattacgacaaagtggaaagcctgtctaacgaagtccgtgcgaagctaatgcaacaccgcccagtctctatcggacaagccagccgtatttcaggcataacccctgcagcaatttcaattttgttggtgaatttgaaaaagcaaggaatgttgaaaagaggtgagttgtaaaattgataaaaccgtggcgatttgttacggtttttttacacaattaagggatactgtaatgaatatttttgaacaaattaaacaaactgaaaataacagagaattttggtctgcgagagaattgcaaccattactcggttatagcaaatgggagaattttcagcaaacaattagccgagctatgcaatcttgtgagacagctggatatagtgtattggaacattttcctgaggtcaggaagatgttcattattggtaatggggcacaacgtgagcaacaagattatcaacttagtcgctatgcttgttatttaattgttcaaaatggcgatcctaaaaaagaggcaattgcagtaggacaaacttattttgctatacaaacacgtcgccaagaattgaccgatgaggcttttacacaattaagcgaagatcgccaaagattattacttcgtcagcaattacgagaacataattccgagttggctgaagcagcacaaaaatcaggcgtagaaacccctgttgattatgctatatttcaaaatcacggctacaaagggctttatggtggaatggattataatgctattcatcaaaataaaggtttgaaacaaagccagaaaattcttgatcatatgggaagtacagaattagcggctaatttattccgagcaacacaaacggcagataagttaaaaagagagaatattcaaggtaaacagcaagcaaatcaaactcattatgatgttgggaaaaaagtacgccaaactattgctgaacttggtggtacaatgcctgaaaatttgccaacaccagaaaaaagcattaaaaagctagagagtgagcagaaaaaacgtgagaaattagcgttaaaaaccggtaataaaaaataagtgataacaggaaattgaatgaaagaaaaagcattgccggaagggtggaataaaataaatataactaaagtatttacccaaatatcaacaacaggtaaaaatatcgcaaccaaagattgtttatctgttggtaaataccctgttattgatcaaggtgctgaatatatttcaggctattttaacgatgaaactaaagttattcctgttgaaaataaggtaattgtttttggtgatcatacaagaaatttcaaattaattgattttgattttattgttggtgctgatggtgtaaaaatttttcaacctgcaaaagatatagatcctgattttttttattatcagtgtttgtcattaaatttacctaataaaggttatcatcgccattttcgttatttgaaagagtgtgattttatttacccttctttttcccaacaacaaaaactcgccaaaaaattcaccgtacttttatctcaagtggcagaaatcaaacaacggcttgagaaaatccctgctttactgaaaacttaccgccaatctgtgctggcaagggctgttaatggagaattatcggcgaaatggcgggaagaaaatggggtaagtttggatagttgggtatatgaaaaagcacaacatatttgtgataaagttcaaagcggttcaactcccaaaggtaatccatttgagcaaaatggcacaattccttttttgaaagtttataatatagtaaatcaagaattaaattttgattacaaacctcaatttgtaactaaagaacaacactcacagcgttcaataacattaccaaacgatgttttgatgaatattgttggtccgccacttggaaaggttgcgattgttacaaatcaatattctgaatggaatatcaaccaagctatcacgctttttagatgtaatcctagaaatttacattataaatttttttactttgtccttcgagaaggtagatttattagagaaatagaacacgatttaaaaggaattgttgggcaaattaatatatctttaagtcaatgtagagatatgattgttcctgtaccaactcttgaagaacaaaactacatcacccaagcggtcgaaaaacacctaaactttgccaatcagcttgaagcccaagtcaatgcggctttggaacgggtaaatttaatgacacaagctattttggcgaaaggatttcgtggggagttgatataattgccaaaattttgccaataattttaaataaaaaccgaggagcgaataatggaaaccaacttctcttttcttcaagcctttccaaccttattcaaacaggttcaatttgcggaacgttatttttctgaagatccgaatacgtcaatgtataaactccgccaatttggcgagtttttagctaagcaaattgccgtacgttttcgtttggctctgcctgaaaatatcacgcaaaatgatcgtttaaaagcattgaaagaatgtcgtcttgatcgtgagattttatcaatgtttcattttctcaaaaatgcaggcaatgaagcggttcacgaagggattgaagatagccaaaaagcaattacagcaatgattgcggcttggcagctttctatttggtttgttcgtacctttggcgataatatggcaaattttgagcctgtaccgttttgtccggattatttacaagcggtaagaaacaatgaaaatcttgcaaaatacactgaaaatccgaccgcttcgcaacaggaagaacagcaattagtcgaagctaatcaagcagaaattcaagccatttccaccgcactttcaaaccaaagcgaagaagaaaaacaagcctttgatgtggcacgcgaaaaacgtgcagcacaagcctttgagcgtttgaagaattatgaattacgtttgttggatgaaaaacaaactcgccttttgatgattgaccctatgttgcgagaagccggctgggaagccgatagtggaaatttggattatcgaaaaggtgttcgccctgaaaaaggacgttatcttgccattgctgaatatccggtggggaaagatcgtgcggattatgtgcttttttgtgggttagtgcctgtagccattgtggaagcaaaaaaggcgaatgtgaatgttgccagtaaagttgcacaagcagagcgttatgcgaaacagtttgagatcacagaaaatttaaccgcaccttgggtgttggcgaaacggacggtcgcttgggcttcagatgaaagtgccaatgatggcttgcatttttatgtaccctttgtgtattcctgtaatggtaaaccttatcttaagcaacagctagaactgtcggggacgtggtttagagatgttcgtcagccgtctaatcttaagcgtgcgttacaacaatttcatacaccagatgtattactggaaatgttaaaaaaagatgaagaacaagcaacgcaaaaactcgaaaatgaaccatttgatttcttggggctacgaccttatcaagagaaagctatccaagcggtagagcagaacttgagtgaaggtaaacgagaaatgttgctggcaatggcaacgggaacaggaaaaacacggacaattacgggattaattcaccgctttttaaaaacggatcgttttcgccgaattctttttttggtggatagaaccgcactggcggagcaagcggaagatacctttggtgggatgaacgtggaacctaaccaaaccttaaatacgttgtataactttgcggtgaatggtgtggttgaacctgaaacgaaagtgaaggtggcgacggtacaatctttggtaaaacagattttttattcgggcgaagctccggcaattgatcaatttgactgtattattgtggacgaagcccatcgtggctatacgcttgatcaagaaatgacagatggtgagttagaatttcaagataatgagcaatatttatccacgtatcgccgagtgttagattattttgatgcagtaaaaattggtttgacggcaaccccagctctacacaccaaagaaatttttggtgagcctgtttttgtctattcttacaaagaagcggtgattgatgattatttggtcgatcacgagcctccgatagagattaagacgaaacttaatcaagatggtattcattttgagcgtggcgagcagttagaatttatcgacaccagtacaggtgaagtggtgttaagtgaacttgccgatgagcaaaattttgatgtagagagttttaatcgcacggtattaaatgacagctttaatcaagtggtttgtgaagttttactggattatcttgatccttttggcagcgaaaaaaccttgattttctgtgcgacagatctacacgctgataagattaaaggcatattagataccttattcaaacaaaaatatggtgatgagtataataccaatgccgtggcgaaaattacggggcaagcggataaacctaatacgcttatcaaatattttaaaaacgaacgttacccgaatatcgccattacggtggatttgctttctacggggattgatgtaccggagatttgcaatttagtctttttacgccgtgtaaaatctcgtgtgctttatgaacagatgaaaggtcgagcgacacgtaaatgtgaagcattagggaaaactgtgttccatatttacgatgcggtgggtttatgccgagcaatggcaagtgtggataccatgaaaccgatagtgaagaacgttcatcaacccatttcgcaattagtggaagaattacaagcggtaggaaaaattgaaaataatgcaaacccactagccaatgaacatcagcaggcattacttgaacaaattagccaaaaaattatgcgattgctgcgtaaagcggacaaaatggcagaaaaaagcccacagatgaaggaaaatctcgctattcttgaacaggaatggggtgtaaaacctaatttgttgcataaacatttacttaagattggcgttcaaggggcggtacaatttttcgaaaaacatcgcaatatcttaaccgaatttaaccgcttgcaagctatgttaccaagcgaacgaatgccggtgatttctacgcacgaagatgaagtgcgagaaattaccccaatctacggaaagggcgaaagtgcggacgattatttgcaagaatttatggcctatattcaacagcatagtaacgacagtgttgcgatacaggtaattattaaccgccctcgcaatcttactcgtcagcagcttaaagatattgagcttgctttagatgcacaggggtttagtaaagcgaaactgaataaagcaatggggcaaaaaacgaaccgtcacatttccgccggtattgtggcgcatatccgccgtgcggcgattggcgatagtcttgttccttttgaacagcgtgttgatcatgcgattgaaaaattgtgccaagcacattcatttaaacccaaccaacaaaaatggttagagcggatcgcaaaacagcttaaacaaaatcacgatgaaatcttagatcgtagtcgtttaaccgagctattccaagggcaatttagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaccctcctgtccagatcaggaggggagaaagggctcagaggagggggtgccggaaaacctcaggtgttcctctcgagggagaccgggatttcggggaactttgtgggtcgcatcaagggtgccaagtgccctttcgacctccaattcctaacgtgggacttctcctgagacgctgtagcgggaaagggcttcatcttgcgatgacgggggagccacgtggtttttctcgagttacggcgggattctcgagttacgacggggaattcaggatgcctcttgtgttggcccaggcaagtccaatcttccattcgagttgcgaaggaaagctggggattgctctcgagtgactgcagggccaatagacctcatctaggcttgtgtccagaagccaatgttcctctccaggggcgacagggatctcggggttgcattccagacgcacccggggagacaggcattcatctcgagtggaagcaaagaaccccgctctgctctcgaatcgcgacgggtatctcttggagctcactgggtggactcaagggagtcaagcctcctgaggcgtttggagagaggtcgcgagattggtctctaggccatgcaggagacgaaggccctcatctctcgatgacgggggaatctcggggttgttctcgagcggcggccccagtgtgcggtttctcacgaggtacgacggcgaggtcagtgagcctctcgtggggcgccagggaagtcgggtctccatgcgagtggcgagggggagcgcgtcattgctcccgagccatggtaggggaatctggcctcgagacgtgttgaagaaggtctctcgaggtctttcccgggttgaggcaggaaaccctgggttccctcgacttgtgcaggtgacctcagggggcttctcatggtggctctgagaagtcagggaaactggaggtgggaggggcctctcgggactccactgggtttggtgcattggaagagggcctcatctccagttgaggcaggaaccgcagggtacctctgatttcagactccgatcgcagggtccctgcagactggggacaggagagtcaggcctcgtcttgggttgaggcatggaactccgcctgcctctcgagatgtccccggggagagaggccgcttgtcgagctgtatttggaacctggggttttttccgaacgatgcacggaaaaactgccccttcgtgttgactgcattcacaggctggagttcggagaggtgtccgggcatcgggttcttatcaagaggggaccgggaaatcggggtcctacggaatgtggaaccacccacgaggccacgtctggaatgtcttcgtgagaccggcctcatcctgaggtgcgaccggaaggtcgggaaccccttccagacaaagcaggggagtcgaccctcctgtccagatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtatttagccttggacggagtttaccgcccgatttgggctgcattcccaaacaacccgactcgttgacggcgcctcgtggtgcggcagggtccgggccggacggggctctcaccctcccaggcgtccctttccagggaacttgggcccggtccgtcgctgaggacgcctctccagactacaattcaggtgacgaagccacccgattctcaagctgggctggtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgttatcgatcagctaaaaaccttagatgctcgtattcaaacccttgatggacaagaggatcgctttgtcacagtcgagaaaaaagacttgctagtggactcttatgtgaaatggaaaatcagcgattttggtcaattttatacttcaactggtggcgatacacaaaaagcttcaaccttattacaacgtaaagtcaatgaccgtttacgttctgaaatcggttctcgtaccattaaagacatcgtttcaggttctcgtggtgaactgatggcaggagcgcaaaaagccttgaatgatggcgaagatggtgcagaacgattagggattgaagtagttgatgtgcgtgtaaaacagatcaacttaccaaatgaagtatcagcctctatttatcaacgtatgcaagctgaacgtgccgccgttgctcgtgaacaccgttcacaaggtgaagaaaaagcagaatttattcgtgctgatgttgataaaaaagtggtactcatcttagccaatgcaaataaacaagaacctgaattttacagttttgtgcgtagtttaaaggcttacgaagaaagttttgctgcaggctcaaacaatatgatgttgcttaaaccagacagcgaatttttccgctttatgaaagcacctacaaaatagttatatccaaagacccgataaagcgggtcttttttatctttaaaatagaaagctacaacgaggttgtaaaattttaggttgttatataacagtttatattagccaaaatgtagggacacactgagtatgtccgctcataaaaaatcatattgaggacacactcagtgtgtccctacagtatgcctgaaagattgaggtttagcgtaactgtaacaaccaaaaaaatctaaccgcttgtatgcttttgacattcactaaacctaactaaaagaggcaatttattatgggtaaaagtgttgcaatccttggggctcaatggggcgatgaaggtaaaggcaaaatcgtagatttattaacggatcgtgtgaaatatgtggttcgttaccaaggtggacacaatgcaggtcacaccttaattatcaacggcgaaaaaaccgtacttcgccttattccatcaggtattttgcgtgaaaacgtgacctgcttaatcggcaacggcgtagttctttccccatcagcattaatgcaagaaatgggcgaattagagtcccgtggtattaacgtgcgtgaccgcttaaaaatctctgaggcttgcccactaattttgccatatcacgttgcaatggatcacgctcgtgaagcggcgttaggtaaaaacaaaatcggcacaacgggccgtggtatcggccctgcttacgaagacaaagtcgctcgtcgtggtctgcgtgtcagcgatctattcaaccgtgaagcctttgcagaaaaattaaaaactattttggaatactacaacttccaactggttcactactacaaagttgagccagtcgattaccaaaaaaccttagatgatgtttttgcggtagcagacatcatcacaggtatggttgcagatattacaaccctattacacaaagctcgtgccaacggcgacaatatcctatttgaaggtgcgcaaggcacaatgttagacattgaccacggtacttatccatttgtaaccagttcaaataccaccgctggtggtattgcaacaggttctggtttcgggcctcgtaatttagattatgtattaggtatcattaaagcttactgtacccgtgtgggatctggtccatttacgaccgaactgttcgatgaagtcggtgcagaaattgctcgtaaaggtaatgaatttggtgcggtcacaggtcgcccacgtcgttgcggttggtttgatgccgttgctgttcgccgtgcaattcaaattaactcaatctcaggtttctgtatgactaaattagatgtacttgatggctttgaggaattaaaaatctgtgtcgcatacaaattacaaaatggcgaaatcgtagaatactcaccgcttgcggcggcaaactgggaaggggttgaaccgatttatgaaaccttaccaggttggaaagagaatactttccgtgtaactaaattagaagatttaccgcaaaatgcgatcaactacatcaaacgcattgaagaagtgttaggtgtaccagtcgatattctttcaacaggcccagaccgtgttgaaacaatgattttgcgtgatccgtttgtagagtaattagattttaacgataacaatcccctggtttgtagaaattaggggattttttgtataaaacagatcggatctgaccgctcgtttacatttatattgcgaacttagtggcaaagtagtgtaaaatagccaagttttcgtgatttatattcatagaggaaaaagaatgaaaagagtagtcatcacaggtatcggcattatttcgagtatcggtaataacaaagaagaagtattagcttcattaaaagaaggtaaatcaggcattgaatttgtacctaaatttgctgaagtgggtatgcgtagccaaattgcagggacgattaaattaaacccggcagaattaattgaccgtaaagtataccgttttatgggcgatgctgcagcttatgcttacctttcaatgaaagaagcgattgaagattcaggtttaaccgaagagcaagtgtctaacgaccgtactggtttagttatcggtgcaggcacaggctctgcacatagtcaattagtggcttgtgatgcagtgcgtggtcctcgtggcgtaaaagcagttggtccttatgccgtaactaagacaatggcttcaagtgtatctgcttgcttagcaaccccttataaaattcgtggtgtaaactactctatcagctctgcttgtgcaacctctgcacactgtatcggtcacgcaatggagttaatccaattaggcaaacaagatgtggttttcgcgggtggtgctgaagagctatcttgggaatgtgcaacggaatttgatgcaatgggtgcagtttcaactaaatacaacgaaaccccaactaaagcttctcgtgcttacgatgccaaccgtgacggcttcgtcatcgcaggtggtggtgctgttgttgtggttgaagagcttgaacacgcccttgctcgtggtgcaaaaatttatgcggaaatcgtaggctatggtgtaacatcagacggttacgatatggttgccccaagtggtgaaggtgcggaacgttgtatgaaacaagcgatggcaacagttaaaggcgaaatcgaatacatcaacgtacacggtacatcaacaccagtgggtgatgtgaaagaattaggcgcaatcaaaaatgtctttggcgataaaaccccagcgatttcatcaactaaatcaatgactggtcactcattaggtgcagcaggtgctcacgaagcgatctactcgctattaatgttagataacgatttcattgcaccaagtatcaacattgaagaacttgatgaacaagcacaaggtgtgaatgtcgtgacagaacgccaagacaaagcattaacaaccgtaatgtctaacagcttcggctttggcggtacaaacgcttgcttagttttccaaaaatatcgaggctaatcttgcttaatttttgaaatctgatataagggagtgggaattttcccacgtcttttttatttatttggagtgaataatgttaaagtttaaacatttattatctattttagtattggcagtttcagcaaatgtcgtggcaagcggtgtatcaatggaaatgtttcaaatgaaacgccaaattaacctattaacgaatgcccaaacagctgaagaatttacgcaaaatgccgataaatttattgaagtgtctaaaaaagcccaagcaactatgccaaatagcttagatggcgatcaagagaaattcaaaggctatcaacaaggtatgcaagaagtcatcgatgtggttgctcaagcaaaaaacttagcaagtcaaggtaatttaacggaagcaaaaacagttattgcacgtttagatagcttaagaaaactgtatcattcgacatataaataaacatctagcctaaagttaaatggacgaaaatggtgtaatagacaaatttgttgcaaaaaagcagcttaaaaaagtctctcccacaatttgtgggagagactcatttattgagaacattaagctatctttctcaataatatcaactagttgcttattcattctctgataggaaataagattacttttatcacgattaaatagtgaattaagtactcgttgagagttaattatttcctcatataaaaaagaattttctaaccgttcaacataatcagcataacttaaaataagttacatttttaccttcttaaattaaacaattttctatttctgatgcattttgttctagctctcttaatacctcgatgaagaattcaagagttttgatcattctaattaattcatccttagaacgttgaattttttccctatacgctggatatccctttgcttttaaggggactatatagttcagcatcatccctcggttttctgctttatcaatttcatctttatatatattaataaaaccatccattttattaatgagtttattaatatcctcaataagtttttctagaatttttatttgacccaaatagttttgtgattcatttgccatagattttcccctctttgactagtttaaagctttctgacattatcagccaatccaccttgtatatgattatttaattgggcttttccccctaatttctctattgcattattggctaatattgcttgagtttgaaagccacttttgtgatttcctaataagaagatagcatctctagttaattcatcaaaatatttccaatgatgctccattgtttgtcgaaaatcattaagcgtattgctgaaaattgcactattaatagcagcccttagatcatcaattgcctttttatttaatttatgccaagtatctattccctcacaaaaattgttacaacaatcaatctggttttgtagagattgcaaattattaaaactcattattttttctccattatttagaatgtcatttactttatttttttacgttattacgtaatttcttaattgggtctaatcctccacctttattaccactattgttgatatcagagcttggattttctaatggacgagatgatgatttctcaatacgagattcatctaaaaaatctcctctcccttgattatctaaatttatcaaaatatttatcccaatctgtatcaactggaggaatgttttctgcagattctgattcttttaaaaagatatcatttttctctttattaatttcactattaaagaaattaataacatcattcttatcgtctagaaccgatattgaagaacttattgaattatctgatagactgctatgcattgaaatatcatctctcgttatcgtattaatcacaatacattcgtaatctcttcctctatattgttcaataacctcttgaaccattaaatcatctgcaggtttattcattaaaatacgttgattattttgcttgactcccattccatcgtttaaaataaactgaaatggttttagataaacaggtgcttcattacctatcataaagattttcattgaatctgatgtattaacagtaaaagcaatacgcattttaaattgtgttaataattcagaacttattgtatagcctgttagtgtctgagtagacataatcatatgcaatccaaaggctcttccccgtttagtcaaatcaatcaataatttctctattttcgaagatttaggatgctcaaatagacattgcacttcatcaataattaaataacttcgacttaactgtgagtctgtagataatttattatattgatctatatttttaacattttttgcttaaataatattcctctttcttttatcaaattagagaatttctgcaatgcatcaataactggatcaacttgtgaattatttaacatcaagactcggatatgcggtaatcctaggtacttctgaaattctacaccttctttataatcaaataggtaaagttccgcttgctctggtgtaaactgagaaacaattcctttaataatatgatctagcagtgttgtttttcccgtgccattcataccgaccataaatgcgtgataggcttgatttcttgctcctaattcaaagtaacatttctctttaccatttggtgttaccccaacctcaatttctaagaatgcttttggtttagatgcttgactaattctatactcttcttttaaattgtttacaacttgattaaagatgtgcttaaccccatctcgttgagataattcaatagtaagtttattatttttgatcagtgtgcttaatttattaaatagatgggaattttcttgaagaaatatatcttttccgattaattctaaacttggtatctgactaagtaatttagtcattctatcacctagtgcctttctttttttatcatcatcaccatttttgagataatggttaaattcttcattgtcaaaataaaaaataaacttaactcctgctgaatatgctgaagcaataatagtgtttagaaaatctaatctatcatttgataccgcataatcattcaaattaataatatttaatatgtaattttcttgtgcccttggatcaacttgttcattatattgataaattgaagtaatattatcatcaattaaattataagatcgctcacgaactaacgaagctaaccattgattaaatttattaatggcatcatcactaaatattgaaatatttttttgctcattaagtcgcataatatttggaaatatgttatataacgacttatcaataatattaattttaggtacttgataacgtattaagcctaaaagaaaatgagcggaaatatcttcacaaagatgggccacattctgcttatccttctctgtatagtgaataagcaaactatgactatcgctaggaatcaccgcaggatagagttgccctctggtcgggtggcgtaattcaccaatgtaaattccccaaggataatgggttccttgaattgcaatatctgtttgaataagctgttcttgcattgctaacctcggtctataactcatttatgctaatttacaattattttgtataaatctgatactatataaccaaattgtacaaaaaaacaactgtgcaatctttaagagaatatattagataattaaatctaagtgttctctaaccaattgtttttaatgaaaattaaacattttaatgtttaaaattaagagattttacaaatgatgtgtataatgcggagaccttataatgtaaaagcccttatcttagttataaaccgtaataacagccttaaataattgcaaaattcaaatctttgtacaactgttacagcatcctattacttgctcaaccccaaaaggaaaataaaatgacaacaatcacattacaacttgacggcttacattgcggcaactgcgtgaaaagtgtagataaagcattacgagaattaccaacagtaagcgacgtgaaaattgatttagcaacccaaattgctgttatcgacggtgaagaacaagcaaaaaccttgattgatgccattgttgatattggctttgaagcaaaagaggcataatctaatggctcaagagcaacaatttttgctcaatggcttacattgtgcatcttgtgttcgccgtgtggaaacggttatcggacgattgacaaacgtggaatatgtgtcagtcaatttagctgatcaaactgcctttgtacaaggtaaggtcacggctgatgcggtagtacaagcggtgacaaaaatcggtttcggtgcagaattgctagaaagcgaagaaattcgtcgggcaaagcagcaagcccaaactgcagcagccttaacccagaagcgtcgtcaatttactgttgcattagcggttggggtaatgttaatggcatacggaatgtggttcggtacgtcgccaactgtagaaaatcgtccgctttggtttgcttgggcggtcatcatcgccagcactatgttttttagcggcaaacacttttttacaggggcgtggacaagtctaaaacatcgtgcagccacgatggacaccttaattgcaattagcacaggcgttgcctttctttattcgctgtatttaacgctatttcctcaatcccattcccatttgtactatgaagccagtgtgatgatcatcggctttctcaatctaggaaaatatcttgagttaaaagtaaaacagcgttcatcgcttgccttagaaaaattgctggatttagcaccgcagcaagcggttgtttttgacggagaaattacaaaaaccatttcaactaaaggtatcaaaccacagatgcggattcaggctctgacaggagacagatttgccgtggacggcgtgttgcagagcggttcattatgggtagatgaatcaatgctcacaggcgaagcgttacctgttgagaaacgagtaggcgataaagtgcgagctggaaccattgttcaagatggtgctggtatttatcttgccgagcaagtgggttcgcaaactgcactagctcggattatttccgcagtccgtcatgcacaatcctctaaaccaccattagcacaatgggtcgataaggttgcgacggtgtttgtgcctattgtggtgagtattgccttgttcagtgcattagtttggttggcattaggtcaggattttgcctttgcattatctattttcacaacagttttaatcatcgcttgcccttgtgccttaggattggctattccactttccaccattgcaggggtcgctcgttcggctgaattgggtgtattagtaagaaatattgaagcactacaagcgagtagtgaaattgatactttggtgtttgacaaaacaggaacccttaccactggcgaaatgcaggttacacagattaacactttaggcaatgtatctgctgacgaagtactacgtttagccaaaagccttgaacagcaaacggctcacccgattgctaaagcgattgtaaaatatcaccctgatctgaccgcttatcctgcgagtaacataaaagttgccaaaggtttagggatttcagctcaagtgggagaaaacaatgtaaaagtaggcaatcggcaatttgttgcttctgacttttgtgaagagcaagatttgactacgcaagttttcgtttcactcaatgaacagctcattggcgtgatctatttgcaagatcaacttcgccctgaaagccaagcggttattacacaatttaaacagcagggctatcgctgcataatgctcacaggcgaccgccaagctacagcaaactattatgccgaaacattgggtttagatgaagtgattgcagaagtgttgccggagcagaaagctgaacaaataacgaagttacagcagcaagggcggaaggtggcaatgatcggtgatgggatcaatgattctcccgcattagctcaagcgaatgtcggtgttgcaatgtacaatggtagtgaaattgcgatagaaactgcggatctctcattaatgcaatcgggattacaaccactagcagcaattttgcccttctcaaaacaggttgtacagaatatgaaacagagcctagtcggtgcctttatttacaatatcattgccattccgattgcttgcggtgtactttatccttttactggctggttattaaacccgatgattgcggcagttgctatggctttgtcgtctgtgactgttgtgttaaatagtcagaggttgttaagataaaagtacaaaatagagagcaaaaaagaattctatttaccatcgtgtcattaccagccccaaccattcaaggagtgatagaggatcactatttaggtgcctgcgttactgttagattcatctatttcagtatttttgagtaatgttattatgctgaagcataacaatcttattttattgcttacagctccgtgccgtaaaactccgctatttttgttcacatccaacgaaaaaagagaaatataaaagccttgaagtttttacatttcaagactttatattatgtttgtctagatctgctgaaatcaatttggtggagataatcgggatcgaaccgacgacctcttgaatgccattcaagcgctctcccaactgagctatatccccaaaattgcgagagatgatatgctctcgctttttttctgtcaatctgaaaacaatggaaatagattaattgattaaaaactaactagttctgagcttcaataaacgcaatcgctttttgaatacgcgcaagcgttctctctttaccaactaacttcgcagtaatatccatagatggcgactgccctgagcctgttactgcaaggcggaatggcatacccactttacccataccgatgtcaagctctgcggcagtttggttcattgcatcgtggatattttcaacactccaatcatcacaagcggtcagtttttccaataattttgcaagtggtgccactgcttctgctttgaagtttttcgctaccgctttttcatcatagctatcaaattcttgatagaaataacggctttggcttgctaattcttttaaggtttttgcacgttcgcttaagactggaatgatctctgctaatgcaggtccttgagagaaatcaatcccctgagcattcatatgccattcaaggtattttgccacatagactggaggcaaactacgcatatagtgttggtttagccactgtaatttttccgtgttaaaggcacttgccgatttgctgacagaatgaatgtcgaataactcaatcatctcttcacgagtgaagatctcttgatcgccgtgtccccagcctaaacgtacgagatagttaattaaggcttcgggtaaatagccatcatcacgatattgcattacgctaactgcaccgtgacgtttggaaagtttttgaccatcatcgccgttaatcatcgaaacgtgagcgtaagttggaatttctgcccctaacgcttttaagatgttgatttggcgtggtgtgttgttgatatgatcttcacctcgaacaacgtgggtaatgcccatatcccagtcatcgacaaccacacagaagttgtaggtcggtgcgccatcggtacggcggataattaagtcgtctaattcgctgttgctgatttcaatgcgtccacgcaccgcatcatcaaaaatcactgatccttccgttgggtttttaaaacgaacaacgtgtggttcgctcggatcgtgtgaatgatcgcctaagcagtggcggtcataacgaggtttctctttattcgcttcttggtttgcacgcaattcatctaaacgcccttttgagcagtagcaacggtatgccgtgccttcttcaatcatttgatcgatcacttggttataacggtcaaagcgtttggtttggaaatatggaccgtgttcccacgctaagttaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgttcctgttgcagggttaccatcaataaatttgcctgtattggattcaatatttggaagttttgttttcatttcttaatacctttaaatgtatgcgaaatagcaataggtgtgagcaggttttaaatctgtaaaaaattcttctaaaattcggtcgccaaaatccgttaatcgttctcctgccacagattgcccagcccgaaaacgagtaatattgttatcaccatttgttatagtaacccgccacatataccccaaatgttctctcggggaattttgaatcggaatatcgcctgcattgggtaaatcgttttgcaaatgagaaaactctttaatttcaatggtatagccaatagacttcgctaactgtataaaataaggcatagaaagccccccaaccgcatttaatgtcagaatgactttattgactctactcgaatacgatttagaaagatcagtacttatcccacaaaccctttcccaatctgccaacatctcacgagatgtatctggggtaactgcattgagcattctttctgcactttgttgtaacaggtcaaaacatcgtccatcaacctcacattgagcaacaaactgctcaccattaatatcataggaaactggaggataaagcgtttttagaacatttgcgtgtaagctcattgcattaactccactgtaactcgccctaacctaaaccattcaacatttggcacagtattcgcttgtaaattagagcttggcgaaataattcgacgatcaacaaccccaatcaagtcactcacaatcgcttcacactgcgatacaatcaagctatctgcagggcttaattgattaaaataattacctaatgcggactcaatttctgctttaatggtgactaaatccacaccactcaatttcactttgatattaaagtccgttcgtctagctgttggtttaataacttttgactctctagccgtaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtcgcattactagctaccctttgctaagatatgacttgtctagggtctgttatcttagtgttatcttagcaaagaacgcacgaaacagattataggaaaagggcatagatgtcaaaatctatgctctttttctatgagaaacaatacaaatattttataattacctaatcttacttaccttttaggtatggggcttagtcgtatgggtaatgattcttttataagattttcttatgttttgttaatgggttttggttttcctattatgcgttatatgagtattcattttgatactttaaataataatgctgttcgatttctctctggtgggttgttattcgtttttatttgtatattaaaatatagaacagaactacttaagttgctcagagaaccttcaatcatcttatatcttcttttgttagctatttttatgactggtaatatgtatttttttattaatggtcttaaatatacttcagctttagcaggcagtatttttggcattatgtctatgcctttagctgttattatggccgcaattttctttcaagatgaaagggaaaaagtaaaacaaaagagcttttatattggtagcgtcttatctgtaattggttctttgatatttgtaatttatagcaacaaaactggtgggggtaatgattttataacagggtcactctttttggggacagctatatttattcaatctattcaaaaccttttcgttaaaaaggtcgcaaaaaaattaaatgccatcgttatcagtgcatccactgctactttatctggacctgtttatctacttttagcaagtaatacaggtgttatttatcaattacaagatattagttcaggcttgctgatcggattaatctttgctggaatgtatggaatgctaacaggtatgttatttgcattttatattgttcaaaaacaaggggtagttgttttcaatattattcaattaacagttcccttatctactgcgtttattggttactttactttaggtgaaactatttctatttatcaaggttttggtgctgcaatcgttattgtaggatgtgttatttcattgaggaaaaaatcccatggagattaatatgtataatgtgggtgttataggattaggcttgattgcttatggtatagataaagatccaaacagaaaaatcatatggagtcatattaaagcatataaaagtattgaaaatatacgaatatcatcagtatgtgatgttaagaaatctttggtagattctatccaaaaagaatgtgatataccaaatggatatacagattataaagaaatgctgaaatctaataaatttgatattgtcagtatatgtacacctattcaaacacattttgatatcatcaaagagtgtattaagaatggagttaaagtgattttctgtgaaaagactgtttcttattctctagaagaatctaaggaaatagttgagttatgcgataagcataatgttattatcgctgttaattacatttttcgttgggataatcttattcaagaaatcaagggactattagattcaaatgctatagggaatatttattctttagttggttatggtgcaactgctttacatacgagtacaagccatttaatagatttattgctttatttttctggttcagatattgaatatgttgttggagatattcaaaaagattttgtgagaaatgttcacggtatttctgatgtcggaggaacaggaatgataaagtttaagtctaattctattgggttcattaaaggtactagttcttccccaatgaaatatatgtttgaattagacatacttggcgaaaatgggcgaataagattatacaacaatggatcatcttatgatttatataaattttcaagtagtgaaaattcatcaggtagcaagtatgaacatttagatttagtctattcaaaacacaatactactccaaatgaaagaatgatagatgccattttaagtctaattgaaggtattgaaacaggaaaacaacctgtatcaaatataaaaacggcaatagaatcaatagaggttattgaaagtataaaactatcatcaatgaatggaaatataattaaatttcaataaatgagcctctcccacaatttgtgtaaatacgacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaatatgtacaagcatattgtgatttaaacggcgttattctaaataataaagtaggtttttatggtacgcgataaacagatagatttttcatatcttcgtaaaattttggactacgatcctgactctggaatttttcattggaaaaccagaggtaataaaagaattgatactcgcttagctggtaaggttgctggagttactgggcgagatggatataaagtaattagaattgatggcattggttactatgctcatagattagcttggtggcacttttttcagcaggaaattgttggagaaattgatcatataaatggtcagcgtgatgacaatcgcatctctaatttaaggactgtctctagattacacaatgcacaaatgagacatagggttcatagctcaagtgggtatatgggagttacttggcataaaagagataagaaatatcaagctagtattaaaagtaaggggaaaaatattcaccttgggtattttaaaagtgccgaagaagcaagtaatgcttatcaagtagccaaacaaaaaattgatgaagagtttatgaatcaatataaacagcggggtgcattttaatgacaaatggaatttttgggggggtgaaataacctacgcttagtggttaagcgtaggtgtaagcgttaagcggttaagattttatccgctgcgattttagctaagaagttgctacggtttttatactctttgtgaacggcaacaaaatcatcaatgcgtttgatgagatagctagggagggtgatgttgatgcgttcggctttgccgagtaaatggctaatatcaacatcaacaaagccgaaaaagaagtcatattctgcaaaatcagggtttttgcggtggttatcaatggaggttggcatcggaatttcttctccatcttcaactaagccttcaaggtggaacacgatggcttctttgacattttgatatgcttcttcgagggtatcgccagcagagaagcaccctggaatatcaggcacgataacgccgtaagcgtgagtttcgtcacctggttcaattgcaattgggtataacatattttgtccttgtggttatagcagggctattttagccccgcttgtttaagtattgagagttcagttcctttttttaaatcctttttcggatgaggcactgttactcgcccttgtttagttggatgtttgaattgatggtggcttccacttgttgcaactaagtaccaaccgtccgcttcaatcattttaattatggttttgctatccacattattgtgctcctttgttgtttttcatgtgtgtattatacttatttttatgtttttatcaactgtttatatgtaagatgtgtattttaggtgaataaatgaaattttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcggcttaatttgactcaacacggggaaactcaccaggtccagacacaataaggattgacagattgagagctctttcttgattctatgggtggtggtgcatggccgttcttagttggtggagtgatttgtctgcttaattgcgataacgaacgagaccttaacctactaaatagtggtgctagcatttgctggttatccacttcttagagggactatcggtttcaagccgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccaagcatttctgctcagggcggttaaaaagttgttgatttacttacacttcgaccaacattgcacatatcatagtgatattcagacaagaagtcaagcctttttacacgttaaaagcatatttctgtaatttgactgcacttttatgatttttaatagcaagatcgagaaactttgcaacaacccactcagaagctttgatactttctccaactttacgctgccaagttcgtaacgttttagacttatctttctgccactgatacttcgcaatcgcatacaccgataacccatacacatatttagcctcaagatacttataatcctgcggacaaggatttttaatgcaataaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtattcgagccgaatttggtgaaacattagatgagttattggcagagttaaatgaggggctgtgggagaaaatggggtaagtttgaattgttaagaaaaatttaatctaagcagtcgaaaaatacctaaattttgtaaatcagcttgaagctcaagttaatgccgctttggaacgggtaaatttaatgacataagccattttggataaaggatgtcagggatagttgtaaaaatcgtgcaaaaaattggatttatggtacactttagttaatttaacttccaaaaggtggaaattatatgctgtttacctatctttttatcgataatatctataatttctcaaatgcagtgattgattttacgttaaaacgtaaaatcttacacagtgctattgatggagaatttcttgatgaacgccctaattttcgttttaagcgggtttgtattctttctggggctaatgcgagtggtaaaacatcactcggtaaaataatgcgttatattcagcattttattttgttcccaaatagtaatttattaaaacaaatcaatgataaagagaaaaatgggttgataaaagtagaatttgttctacctgaaaataatactattcattatttagaaattgtacagtcaatagcaagaaaatcagaatatcctttaattaaatatgcttcaattcctattttggataaagatactagcacatcagcaagaaagcgtttgatggaattttttgctaaaaaaggaaattcaaatattaagaatggcaattattatgaaactgaagataataatcctatttttttatttgacaatattcgtcaaaagatagcagaaaatttatgtttttattatatgttttctgataatacagataaaagtcaattatctattcaagatggacatttaaatgcgggtattttagaaaccgtacttaaaacgtttgatccctcaattgtttcagttaatgaattacgtaatcaagatgaacttgaaggatatagtattcgttttagtaataaggatagtgtattgattgataaaaatggtgatattcccaataaagatcgtttatcaaaagggacgtttgatgcaattcaagttgctgattttatcgcttttatattacagaatgcagaacaaaataaatcattgaaatctgtttgtgcaatctattttcttgatgaaaaaatggcatatagtcattctgaaattgaacaagcgattgtgaatttaatttcacaaaaaatgatgcgttatgctcaatttatttatacaacgcataattacgatgttttagatttgaatctaccaatacattcatttgttttcttacataagactggcgataaagcagagtttattcaaccagaacaaaaatttaagaaaaatgatcgttcattgcttaattatgttcaaaataatgtattttatactattcctgatacgtcattattagatgaattgttatagggtcttgcggatgaaaaagagaacaacgatccaatttttagtagaaggtcaaacagaacgagaatttattaaagctttaaatttgttaggtaaagtgcagcttattaatttatgggataaggatatttcttctatcttagcgagattaagagctgatgaaatttatattatttatgatacagatgttattcataatatagaacgttttactcgaaatctccgtgttctaaaacaacaaaaaataaagttctttttattacagcaaactaaaaatcttgaagatgagatagttcgttgttctaattgccaaacaattaaagatgtttttggtacgggaataaaagaatttaaagaacaatttttagcgtgcaataaccttgaatataaattagccgaaataggcattaaacatcttgatttatggcaaggtaaacaccttgaacaactttctgaatggaaaaatttaagaagaaaattttctgatttagcctcttcaaaataaggttgattatgacaaataacgaaatagtccaaaaactttggaatttgtgtgatgtgctacgtgatgatggcattaactacaacgactatttaaccgaattggtgatgttgctgtttattaaaatggtgcacgaaaaagagcaattatttattgaagagaaaacagaatttaaaccattattacccgaaggttgccgttgggaagatttaagcggtaaatcaggtatcaatcttttagataactatcgccgtatgttgcttgtgctttcaacgggtaaagaaaatgatgagatcgttcataataacccgttattgttagcgatttatgccaatgcaaaaacctcattaacgcaaccaaagcatttagagcaattagtgcgtaactttgatgaaatggattggttctcggcgcaaaaagatggtttgggcgatttatatgagggattgcttgaaaagaatgccactgaaacgaaatcaggtgcagggcaatattttacgccacgtgcattgattaactcgatggtacgttgtattaaccccgtggttggagaggtaattcaagatcctgccgctggaacagctggctttttgattgctgccgaccaatatatgcgcaacaaaaccgatgattattttgatttaagcgaacaagatcgtcattttcaaattcacgaagcctttaaaggggtggagttagtgaccaatactcgtcgccttgcgttaatgaactgtttattacacggtattgaaggtggttcagaaggggcggttattcaaggtaacagcttaggtgatgtgggcaaaaatttaaaacctgctgatattatccttgctaatccgccatttggcaccagtaaaggcggtgatgcggtgataacccgtgatgatttaacctttgaaacgactaataaacagctggctttcttgcagcatatctatcgtaatttaaaagaaggtggacgtgcggcggtggtgttgccggataatgttttgtttgaagccggtaaagggacggatattcgcaaagatttaatggataaatgtcatttgcatacgattttgcgtttaccaacggggattttttatgctcagggtgtgaaaaccaatgtgctgttttttgacaaagtcagtaacgatgcggaaaattcaactcaaaaaacgtgggtttatgatttacgtacaaatatgccgagctttggtaagcgtactccgtttacagaaaaataccttgaagcctttgaaaaggtatttaatccgaccgaacttgatgtcaataaagcgaatataacgatgattttgagtgctcgccaagaaggggagtggagctataccgaaggggaacaaacagcggaaaatagtcgttggaaatgttttgatcgcacttatattcgagatgtaaaaggcgatagtttagatattagctggcttaaagataatgccgctgttagcagtgaagatttgcctgagccagaagagctgattgcggaagcaaaagccgaattggaagcagcccttgcagggttagatgaactattcgcagaattaaccacaaaataggataaacaaaatgttagccaaattagaccgcttgctcagtcaagcaaacattcccttgaccgatcagcaaaaacagcagttggttgatttcgtcaaattattggataaatggaacaaggcgtataatctcacttctgtgcgtaatcccgatgaaatgttggttaagcatattatggatagccttgtagtaagccaacatttacaaggacaacagtttattgatgttggaacaggaccaggtttaccgggtattccgctggcgatagccaatccagataagcagtttgtgttgttagatagcttaggcaaacgcattacctttatcaaaaatgccattcgtgagctaaaactcaccaatgtcactcctgtgctaagtcgggttgaagagtatcaagagcaacaatttgacggcgtattaagccgagcttttgcctcgctaaatgatatggttgattggtgttaccatttgccgaatacaagcggtcacttttatgcgttaaaaggacagtatcagccagaagagttggcagaagtgagcaaaccgattgagttggtggacgtgattaaattgaacgtacctgagttagtcggagagcgacatttggtggtattgaatagataataataggtacagtggtagtgtaatagacaaaatagttttcaaaaagtagattaattccttgtaatatagtgctaattcaacttttagtaaccattttgtctactatgttttttcttccaacccctatcttcctgccctcgccacaaacgctgaatattatcgtgatggcgatagactaatagacaacaaactaatgcgacagggaatgttaattcagagctaaaccaccaaatataaagtggaacgatcaatgctgtaataactgcacttagcgatgaataaccagaaatcaaaaaaacgaacaaccacgttcccaccgctaatccagcaactgaatagcccattggaatgattgctccaaaggcagttgcaacccctttgccacctcggaacttaaagaaaacggggaaaatatgtccaagacaagctgccaaagcaataaagccaatcaccgaaattggcagttctaaataaaaaccaagagaaacaggtagcataccttttaagatgtccgccattaaaacacctaatgccgataactttccgcctatgcgtaggacgtttgttgccccagggttatgtgatccgtgttctcgtggatcgggtagtcctgctaatcgacaaaaaatgacggcacttgaaatagaaccaagcaaatatgcccctaaaatcagtaaataagcaataacgctcattttttccccttatttgttgcttactttgtgctatattttaccttaactttcaaaaagaaaaacaaggaaagatccgatgactgataaagtttttattcacgaactcaccgcttttgcctctattggggcttatgagtgggaacataccattaaacaacgtttagttttcaatattgaaatggcgtgggattttagccgagccgtcgcagatgatgatgtgcaatactgcttaaattatgcggaagtttcacaaaagattcttgattttgttgaaaatacaccgtttaagttggttgaaaccgttgcttatcgagtggccgaactactgcaacacgagtttggggtgaaatcattacgcattgaattacacaagcctaaagcagttgctcaatcctcaagtgttggtgtaattgttgaacgataaagcgtactattattactaaatgcgatctagatcacagttatcccattgatttctcattataattttcgcccctaatttttagcataaaggagcattctatgcctacaatgatcgatatccaagaacgtttaatcgaacttgttgcagaaaaacaaaaccctgttgttcaagcggttgtggagcagttaattcgacaaaacaataaagcatacttttctgcagaacaggtcaccacattttgtcaaacattcaacctatcccctgtcgaacttgctttagaatgcttacctattgcggcttgctacgccagagtgcctgtttctcatttttttgtaggggctgtggcgatt

(The sequence listing continues in the following parts.)

What is claimed:

1. A vaccine for *Haemophilus* parasuis, serovar type 4, comprising a veterinarily acceptable carrier and an immunologically effective amount of killed bacterin or bacterial cell culture capable of triggering an immune response that protects swine against *Haemophilus* parasuis infection;

wherein the DNA sequence of the bacterin or bacterial cell culture comprises SEQ ID NO: 2; and wherein the killed bacterin or bacterial cell culture is chemically inactivated.

2. A vaccine for *Haemophilus* parasuis, serovar type 4, comprising a veterinarily acceptable carrier and an immunologically effective amount of killed bacterin or bacterial cell culture capable of triggering an immune response that protects swine against *Haemophilus* parasuis infection, wherein the DNA sequence of the bacterin or bacterial cell culture comprises SEQ ID NO: 3; and wherein the killed bacterin or bacterial cell culture is chemically inactivated.

3. The vaccine of claim 1, further comprising the vaccine against *Haemophilus* parasuis, serovar type 5 according to SEQ ID NO: 1.

4. The vaccine of claim 2, further comprising the vaccine against *Haemophilus* parasuis, serovar type 5 according to SEQ ID NO: 1.

5. A method for vaccinating swine against *Haemophilus* parasuis infection, serovar type 4, comprising the step of administering the vaccine of claim 1.

6. A method for vaccinating swine against *Haemophilus* parasuis infection, serovar type 4, comprising the step of administering the vaccine of claim 2.

7. A method for vaccinating swine against *Haemophilus* parasuis infection, serovar type 4, comprising the step of administering the vaccine of claim 3.

8. A method for vaccinating swine against *Haemophilus* parasuis infection, serovar type 4, comprising the step of administering the vaccine of claim 4.

* * * * *